(12) United States Patent
Reich et al.

(10) Patent No.: US 7,807,814 B2
(45) Date of Patent: Oct. 5, 2010

(54) COMPOSITIONS AND METHODS FOR COMBINED THERAPY OF DISEASE

(75) Inventors: Samuel J. Reich, Bala Cynwyd, PA (US); Michael J. Tolentino, Lakeland, FL (US)

(73) Assignee: The Trustees of the University of Pennsylvania, Philadelphia, PA (US)

(*) Notice: Subject to any disclaimer, the term of this patent is extended or adjusted under 35 U.S.C. 154(b) by 621 days.

(21) Appl. No.: 11/021,541

(22) Filed: Dec. 23, 2004

(65) Prior Publication Data

US 2006/0287259 A1     Dec. 21, 2006

Related U.S. Application Data

(60) Provisional application No. 60/532,099, filed on Dec. 23, 2003.

(51) Int. Cl.
| | |
|---|---|
| C07H 21/04 | (2006.01) |
| C07H 21/02 | (2006.01) |
| A61K 48/00 | (2006.01) |
| C12N 15/63 | (2006.01) |

(52) U.S. Cl. ............... 536/24.5; 536/23.1; 536/24.31; 536/24.33; 514/44; 435/320.1

(58) Field of Classification Search ................ None
See application file for complete search history.

(56) References Cited

U.S. PATENT DOCUMENTS

| | | | |
|---|---|---|---|
| 7,153,667 B2 * | 12/2006 | Shen et al. ............... | 435/68.1 |
| 7,217,572 B2 | 5/2007 | Ward et al. | |
| 2003/0069195 A1 * | 4/2003 | Farrar et al. ............... | 514/44 |
| 2003/0157030 A1 | 8/2003 | Davis et al. | |
| 2003/0216335 A1 | 11/2003 | Lockridge et al. | |
| 2004/0259247 A1 * | 12/2004 | Tuschl et al. ............... | 435/375 |
| 2005/0019927 A1 | 1/2005 | Hildinger et al. | |
| 2005/0220768 A1 * | 10/2005 | McVey et al. ............... | 424/93.2 |
| 2006/0216295 A1 | 9/2006 | Crabtree et al. | |
| 2007/0155686 A1 | 7/2007 | Akine et al. | |
| 2007/0155690 A1 | 7/2007 | Chatterton et al. | |

FOREIGN PATENT DOCUMENTS

| | | |
|---|---|---|
| WO | WO 03/063904 A2 | 8/2003 |
| WO | WO 03/085110 A2 | 10/2003 |
| WO | WO 03/099298 A1 | 12/2003 |
| WO | WO 2005/032486 A2 | 4/2005 |
| WO | WO 2005/035759 A2 | 4/2005 |
| WO | WO 2006/038208 A2 | 4/2006 |
| WO | WO 2006/110813 A2 | 10/2006 |

OTHER PUBLICATIONS

Hammond et al., Post-Transcriptional Gene Silencing by Double-Stranded RNA, 2001, Nature Reviews, Genetics, vol. 2, pp. 110-119.*

Scherer et al., Approaches for the sequence-specific knockdown of mRNA, 2003, Nat. Biotechnol., 21(12), pp. 1457-1465.*

Mahato et al., Modulation of gene expression by antisense and antigene oligodeoxynucleotides and small interfering RNA, Jan. 2005, Expert Opinion on Drug Delivery, vol. 2, No. 1, pp. 3-28.*

Zhang et al., Targeted Gene Silencing by Small Interfering RNA-Based Knock-Down Technology, 2004, Current Pharmaceutical Biotechnology, vol. 5, p. 1-7.*

Filleur et al., SiRNA-mediated Inhibition of Vascular Endothelial Growth Factor Severely Limits Tumor Resistance to Antiangiogenic Thrombospondin-1 and Slows Tumor Vascularization and Growth, Jul. 15, 2003, Cancer Research, 63, pp. 3919-3922.*

Dawson et al., Pigment Epithelium-Derived Factor: A Potent Inhibitor of Angiogenesis, 1999, Science, 285, pp. 245-248.*

Kim et al., 8-CL-Camp Induces Cell Cycle-Specific Apoptosis in Human Cancer Cells, 2001, Int. J. Cancer 93:33-41.

Zhang et al., Vector-based RNAi, a ovel tool for isoform-specific knock-down of VEGF and anti-angiogenesis gene therapy of cancer, 2003, Biochem. Biophys. Res. Comm. 303:1169-1178.

Zhang et al., Targeted Gene Silencing by Small Interfering RNA-Based Knock-Down Technology, 2004, Curr. Pharmaceutical Biotech. 5(1):1-7.

Mahato et al., Modulation of gene expression by antisense and antigene oligodeoxynucleotides and small interfering RNA, 2005, Expert Opin. Drug Deliv. 2(1):3-28.

Scherer et al., Approaches for the sequence-specific knockdown of mRNA, 2003, Nature Biotech. 21(12):1457-1465.

Yin et al., siRNA agents inhibit oncogene expression and attenuate human tumor cell growth, 2003, J. Exp. Therap. and Oncol. 3:194-204.

Sun et al., Gene transfer of antisense hypoxia inducible factor-1 α enhances the therapeutic efficacy of cancer immunotherapy, 2001, Gene Therapy 8;638-645.

Reich et al., Small interfering RNA (siRNA) targeting VEGF effectively inhibits ocular neovascularization in a mouse model, 2003, Mol, Vision 9;210-216.

Caplen, RNAi as a gene therapy approach, 2003, Expert Opin. Biol. Ther, 3(4):575-586.

* cited by examiner

*Primary Examiner*—Amy Bowman
(74) *Attorney, Agent, or Firm*—Pepper Hamilton LLP

(57) ABSTRACT

A desired physiological state can be induced by altering the amount of gene products in target cells of a subject. The target cells are treated with at least one compound designed to reduce expression of at least one first gene by RNAi, and with at least one compound designed to increase expression from at least one second gene. The reduced expression of the first gene and the increased expression from the second gene in the target cells induces the desired physiological state in the subject. By altering target cell gene expression in this way, conditions such as angiogenesis or tumor growth and metastasis can be inhibited.

4 Claims, 13 Drawing Sheets

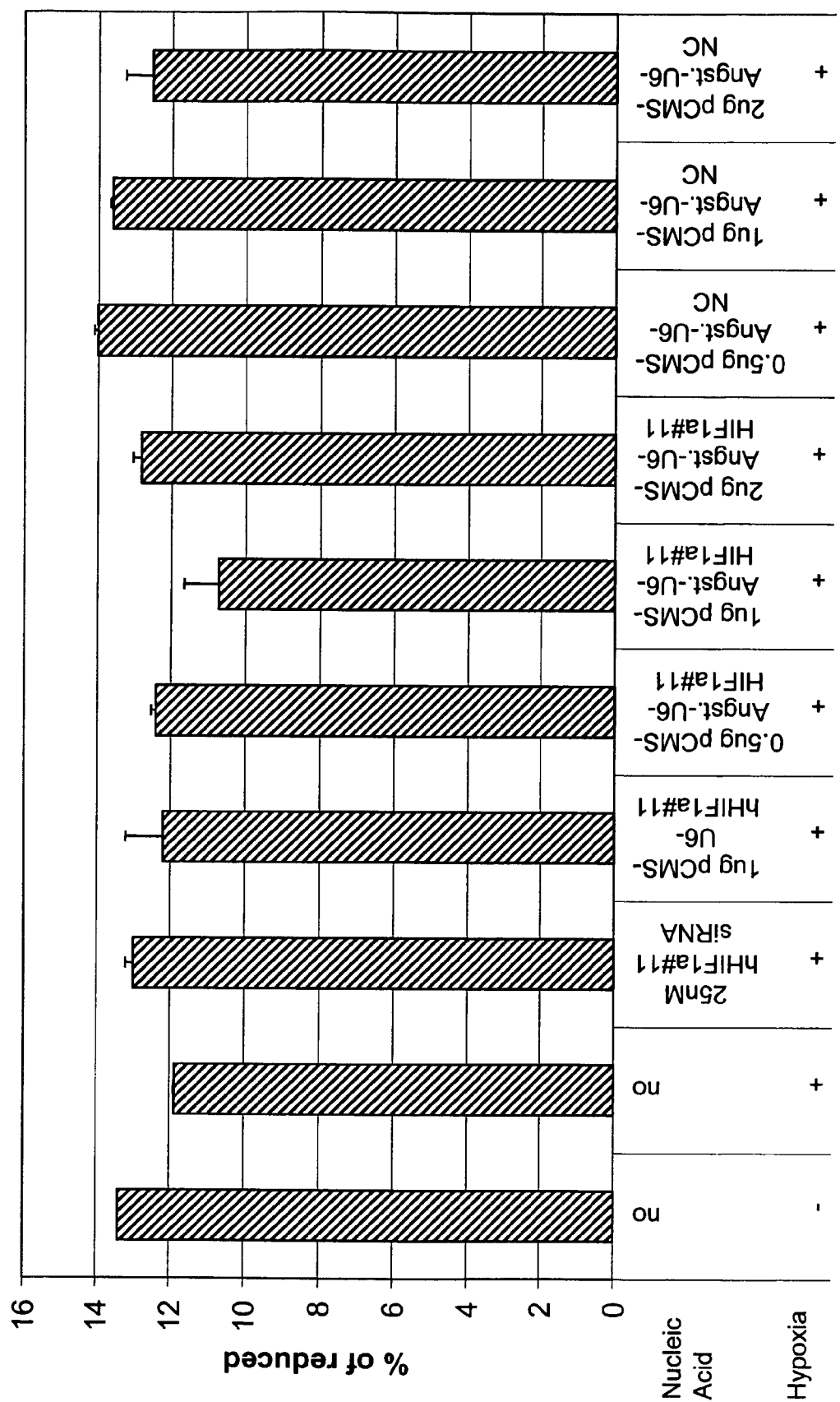

COMPOSITIONS AND METHODS FOR COMBINED THERAPY OF DISEASE

CROSS REFERENCE TO RELATED INVENTIONS

This application claims the benefit of U.S. Provisional Application Ser. No. 60/532,099, filed Dec. 23, 2003, the entire disclosure of which is herein incorporated by reference.

FIELD OF THE INVENTION

This invention relates to compositions and methods for treating diseases, in particular angiogenic diseases, by reducing expression of at least one gene and increasing the amount of gene product from another gene in a cell to achieve a desired physiological effect.

BACKGROUND

In mature human tissues, the ability to initiate angiogenesis (also called "neovascularization") is typically held under strict control through a balance of pro- and anti-angiogenic factors in the cells. Angiogenesis therefore occurs only under certain controlled circumstances in the adult, such as in wound healing or during certain stages of the menstrual cycle. Uncontrolled or inappropriate angiogenesis in mature organisms can cause a pathogenic condition.

For example, neovascularization of the choroid in the eye causes severe vision loss in patients with age-related macular degeneration (AMD). In diabetic retinopathy (DR), the iris, retina and optic nerve can be damaged by ocular neovascularization. Together, AMD and DR account for the majority of patients suffering from irreversible blindness worldwide. The pathogenic neovascularization seen in both AMD and DR are believed to involve an imbalance between pro- and anti-angiogenic factors in cells of the eye.

Many solid tumors will also initiate angiogenesis to ensure an adequate blood supply. The new blood vessels allow tumors to grow, damaging the surrounding normal tissues. The increased vascularity of the tumors also increases the ability of metastatic tumor cells to colonize distant sites in the body. The angiogenesis initiated by tumors is also thought to involve an alteration of the balance between pro- and anti-angiogenic factors in tumor cells.

Many of the intracellular pro- and anti-angiogenic factors have been identified. The primary pro-angiogenic factor is vascular endothelial growth factor ("VEGF"), also called vascular permeability factor ("VPF"). VEGF exists in at least four different alternative splice forms in humans ($VEGF_{121}$, $VEGF_{165}$, $VEGF_{189}$ and $VEGF_{206}$), all of which exert similar biological activities. Angiogenesis is initiated when secreted VEGF binds to the Flt-1 and Flk-1/KDR receptors (also called VEGF receptor 1 and VEGF receptor 2), which are expressed on the surface of endothelial cells.

Flt-1 and Flk-1/KDR are transmembrane protein tyrosine kinases, and binding of VEGF initiates a cell signal cascade resulting in the ultimate neovascularization in the surrounding tissue. Flt-1 and Flk-1/KDR are therefore also pro-angiogenic factors.

Another pro-angiogenic factor is the alpha subunit of hypoxia-inducible factor 1 (HIF-1). HIF-1 is a heterodimeric basic-helix-loop-helix-PAS transcription factor consisting of HIF-1 alpha and HIF-1 beta subunits. HIF-1 alpha expression and HIF-1 transcriptional activity increase exponentially as cellular oxygen concentration is decreased.

Yet another pro-angiogenic factor is ICAM-1, which is a 110 kilodalton member of the immunoglobulin superfamily that is typically expressed on a limited number of cells at low levels in the absence of stimulation. Upon stimulation with inflammatory mediators, a variety of cell types (e.g., endothelial, epithelial, fibroblastic and hematopoietic cells) in a variety of tissues express high levels of ICAM-1 on their surface. The interactions of the endothelial cells with the ECM during angiogenesis require alterations of cell-matrix contacts which are caused, in part, by an increase in ICAM-1 expression.

Two further pro-angiogenic factors are angiopoietin-1 ("Ang1") and angiopoietin-2 ("Ang2"). Ang1 can act in concert with vascular endothelial growth factor ("VEGF") to promote angiogenesis, although inhibition of Ang1 alone appears to block neovascularization. Ang2 is a context-dependent competitive antagonist of Tie2, but can also activate Tie2 under certain conditions. Thus, Ang2 can be pro- or anti-angiogenic depending on the intracellular environment. The Tie2 receptor can also be considered a pro-angiogenic factor.

Pigment epithelium-derived factor or "PEDF" is a potent anti-angiogenic factor. PEDF was first identified in retinal pigment epithelial cells, but it is also produced by other cells of the eye. Hypoxic conditions in the eye lead to downregulation of PEDF expression, and patients with AMD often lack PEDF in their vitreous.

Another anti-angiogenic factor is angiostatin, which is a proteolytic fragment of plasminogen. Adeno-associated viral vectors expressing angiostatin inhibit angiogenesis in rat and mouse models of ocular neovascularization. Endostatin also has anti-angiogenic properties, as demonstrated by a reduction in the size of laser-induced choroidal neovascularization in mice with high serum levels of endostatin. Subretinal injection of endostatin in a mouse model of retinopathy-of-prematurity also inhibited retinal neovascularization.

A mutant form of the "tissue inhibitor of metalloproteinase-3" or "TIMP-3" gene has been implicated in a macular neovascular disease called Sorsby's fundus dystrophy, and wild-type TIMP-3 has anti-angiogenic properties. Thus, TIMP-3 is considered to be an anti-angiogenic factor. TIMP1, 2 and 4 are also known to be anti-angiogenic factors.

Non-angiogenic diseases or physiological conditions can also result from a change in the relative amounts of certain gene products within a cell. For example, the Bcl-2 gene family includes anti-apoptotic (Bcl-2, $Bcl-x_L$) and pro-apoptotic ($Bcl-x_S$, Bak, Bax) genes. Members of the Bcl-2 family can mediate survival of erythroid cells. Altering the amount of gene products produced from pro- and anti-apoptotic Bcl-2 gene family members can lead to an increase in red cell destruction and anemia. Similarly, if the ratio of Bax to $Bclx_L$ is increased in a cell, that cell undergoes apoptosis. Induction of apoptosis of specific cell types has implications for directed therapy of diseases such as cancer.

RNA interference ("RNAi") is a method of post-transcriptional gene regulation that is conserved throughout many eukaryotic organisms. RNAi is induced by small or short (i.e., <30 nucleotide) double stranded RNA ("dsRNA") molecules which are present in the cell. These short dsRNA molecules, called "small or short interfering RNA" or "siRNA," cause the destruction of messenger RNAs ("mRNAs") which share sequence homology with the siRNA. It is believed that the siRNA and the targeted mRNA bind to an RNA-induced silencing complex ("RISC"), which cleaves the targeted mRNA. The siRNA-induced RNAi exhibits multiple-turnover kinetics, with 1 siRNA molecule capable of inducing cleavage of approximately 1000 mRNA molecules. siRNA-mediated RNAi is therefore more effective than currently available technologies for inhibiting expression of a target gene, which bind to the target mRNA or protein in a 1:1 ratio. However, while RNAi can efficiently reduce the amount of cellular factor gene expression in a given cell, it does not increase the amount of anti-angiogenic factors within a cell.

PEDF has been delivered to retinal pigment epithelial cells by adenoviral and adeno-associated viral (AAV) expression vectors, and has reduced the level of experimentally-induced neovascularization in mice. AAV vectors expressing angiostatin and endostatin injected into the eye have also been used to rescue mouse models of ocular neovascularization. Ocular neovascularization in the mouse has also been inhibited by systemically-injected AAV vectors expressing endostatin. The systemically-injected AAV vectors transduce cells of the liver and cause increased serum levels of endostatin. These studies show that anti-angiogenic factors can inhibit ocular neovascularization regardless of whether the factors are produced in the eye or are provided systemically. However, increasing the level of anti-angiogenic factors in a given cell does not remove the pro-angiogenic signals still present within the cells.

What is needed, therefore, are compositions and methods which decrease expression of certain cellular factors and increase the level of other cellular factors in a given cell, in order to control different physiologic states in a subject. Compositions and methods which can both up-regulate anti-angiogenic factors and efficiently down-regulate pro-angiogenic factors in a given cell are particularly desirable.

SUMMARY OF THE INVENTION

Different physiological states can be induced by decreasing expression of certain cellular factors by RNA interference ("RNAi") in a cell, while increasing the level of other cellular factors in that same cell by conventional means. The use of RNAi to decrease gene expression is particularly advantageous in this context, as substantially all expression of a given cellular factor can be inhibited.

The invention therefore provides a method of inducing a desired physiological state by altering the relative amounts of gene products in target cells of a subject. The target cells are treated with an effective amount of at least one RNAi compound to reduce expression of at least one first gene, and with an effective amount of at least one compound that increases expression from at least one second gene present within the cell. Expression of the first gene in the target cells is reduced by inducing RNAi of the first gene. The reduced expression of the first gene and the increased expression from the second gene in the target cells induces the desired physiological state in the subject.

The invention also provides methods of treating an angiogenic disease or inhibiting angiogenesis in a subject by altering the relative amount of gene products in target cells of the subject. The target cells are treated with an effective amount of at least one RNAi compound to reduce expression of at least one pro-angiogenic gene, and with an effective amount of at least one anti-angiogenic compound to increase the level of anti-angiogenic factor from at least one anti-angiogenic gene. Expression of the pro-angiogenic gene in the target cells is reduced by inducing RNAi of the pro-angiogenic gene. The decreased expression of the pro-angiogenic gene and increased level of anti-angiogenic factor from at least one anti-angiogenic gene in the target cells inhibits angiogenesis in the subject.

The invention also provides methods of inducing apoptosis in target cells of a subject by altering the relative amount of gene products in the target cells. The target cells are treated with an effective amount of at least one RNAi compound to reduce expression of at least one anti-apoptotic gene, and with an effective amount of at least one pro-apoptotic compound that increases the level of at least one pro-apoptotic factor from at least one pro-apoptotic gene present within the cell. Expression of the anti-apoptotic gene in the target cells is reduced by inducing RNAi of the anti-apoptotic gene. The decreased expression of the anti-apoptotic gene and increased level of at least one pro-apoptotic factor from at least one pro-apoptotic gene in the target cells induces apoptosis in the target cells.

BRIEF DESCRIPTION OF THE FIGURES

FIG. 11 is a histogram showing a cytotoxicity assay of HEK 293 cells transfected with siRNAs or plasmids as indicated. The cytotoxicity assay was performed with Alamar-Blue by measuring cell proliferation 48 hours after transfection and hypoxia induction.

DETAILED DESCRIPTION OF THE INVENTION

Figure 1A:
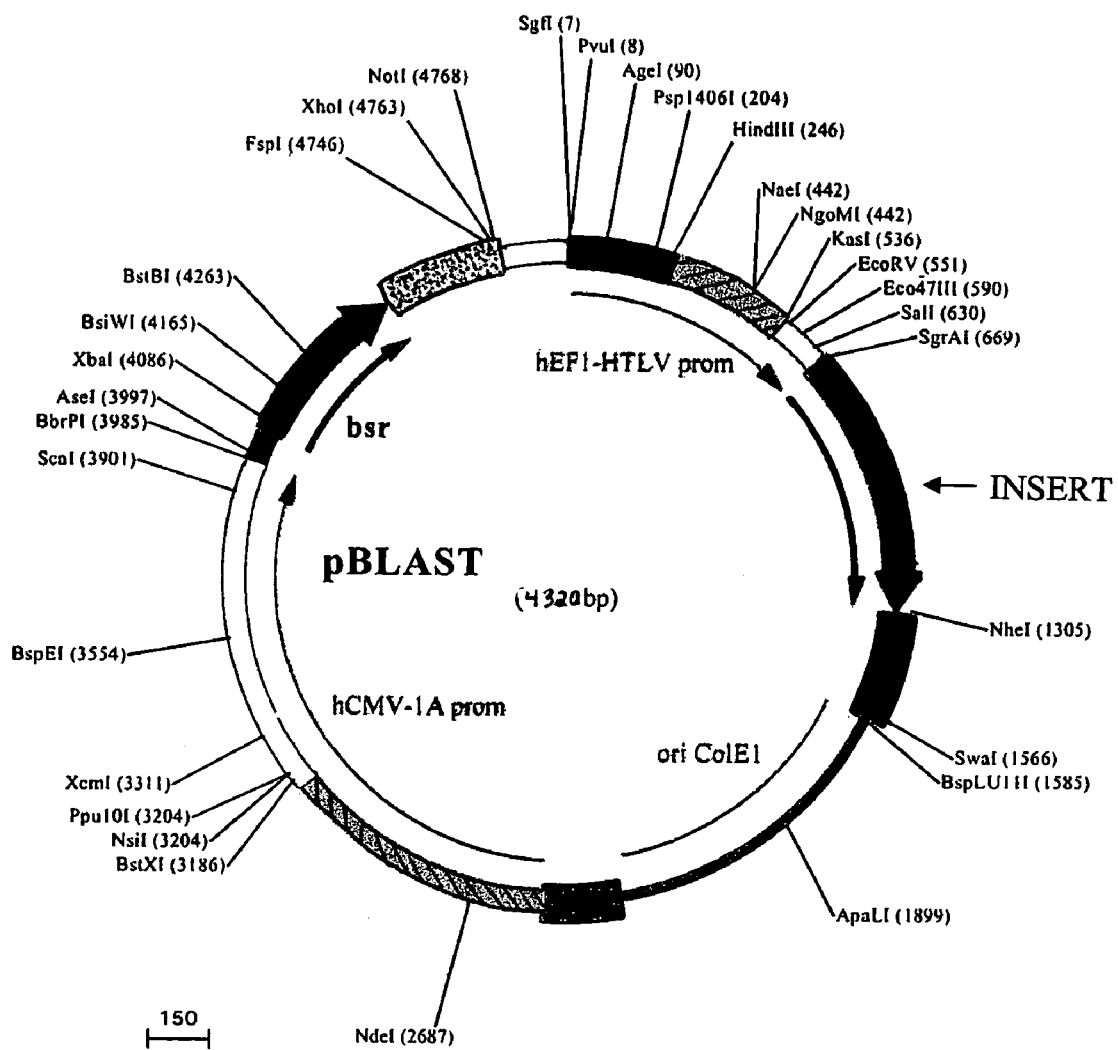
FIGS. 1A-1C are maps of exemplary vectors which can be used to construct plasmids of the invention which express RNAi compounds. 1A—vector pBLAST, which contains a multiple cloning site (MCS) with SgrAI, SalI, BamHI, PstI, NcoI and NheI restriction sites. 1B—vector pORF, which contains an MCS with SgrAI, SalI, BamHI, PstI, NcoI and NheI restriction sites. 1C—vector pORF9, which contains an MCS with SgrAI, SalI, BamHI, Eco47III, PstI, NcoI and NheI restriction sites. Each vector is shown with nucleic acid sequences to be expressed (indicated as "insert") inserted into the MCS.

The instant application contains a "lengthy" Sequence Listing which has been submitted via CD-R in lieu of a printed paper copy, and is hereby incorporated by reference in its entirety. Said CD-R, recorded on Dec. 21, 2004, are labeled "Copy 1" and "Copy 2", respectively, and each contains only one identical 720 KB file (DBR-04-1324R.doc).

Unless otherwise indicated, all nucleic acid sequences herein are given in the 5' to 3' direction. Also, all deoxyribonucleotides in a nucleic acid sequence are represented by capital letters (e.g., deoxythymidine is "T"), and ribonucleotides in a nucleic acid sequence are represented by lower case letters (e.g., uridine is "u").

Many cellular processes that mediate physiological states in an organism are controlled by the interaction of cellular factors which have opposite or antagonistic effects. A change in the relative amounts of these factors within a cell can initiate or inhibit a given physiological state. If the relative amounts of certain cellular factors are altered inappropriately, a pathologic physiological state can result.

For example, a cell which experiences hypoxic conditions can over-produce pro-angiogenic factors, causing the ratio of pro- to anti-angiogenic factors to increase. The increased ratio of pro- to anti-angiogenic factors results in the stimulation of angiogenesis. Angiogenesis can be inhibited by reducing the amount of pro-angiogenic factors and increasing the amount of anti-angiogenic factors inside a cell. Cells can also be induced to undergo apoptosis by altering the relative amounts of pro- and anti-apoptotic factors within a cell. For example, increasing the ratio of Bax to BclxL (or other anti-apoptotic factors) can induce apoptosis in a cell. Induction of apoptosis in certain cells can be used therapeutically to selectively remove those cells from a subject. For example, tumor cells can be induced to undergo apoptosis by the present methods as a treatment for cancer.

Thus, the invention provides a method of inducing a desired physiological state in a subject by reducing the expression of genes encoding certain cellular factors, and increasing expression of genes encoding other cellular factors, within target cells of the subject. As used herein, a "subject" includes any human or non-human animal; for example, a fish, reptile, bird or mammal. Preferred subjects are mammals, in particular ovines, bovines, rodents, felines, canines or primates. Particularly preferred subjects are primates, for example humans.

In the practice of the present methods, the target cells are treated with RNAI compounds designed to reduce expression of at least one first gene encoding a cellular factor which promotes a certain phenotype within the target cell. The target cells are also treated with compounds designed to increase the amount of a cellular factor from a second gene which is present within the cell. The cellular factor from the second gene induces the opposite phenotype than the first cellular factor, or is antagonistic to the first cellular factor. The amount of cellular factor from the second gene can be increased inside a cell by conventional means. For example, expression of a gene already present in a cell can be up-regulated, an expression vector encoding the cellular factor can be introduced into a target cell, or the cellular factor can be administered directly to the cell. Thus, the compounds designed to increase the amount of a cellular factor can comprise any substance which effect upregulation of a given gene or provide an increased amount of the gene product; for example, the cellular factor itself, an expression vector expressing the cellular factor, or transcriptional enhancers of the cellular factor gene. The reduced expression of the first gene and the increased amount of cellular factor from the second gene in the target cells induces the desired physiological state in the subject.

As used herein, a "physiological state" is any normal or pathologic condition in an organism. The physiological state can manifest at the cellular level (e.g., cell death) or the tissue level (e.g., inflammation, necrosis or angiogenesis). The physiological state can also manifest systemically, including through the production or amelioration of clinically observable symptoms.

A "normal condition" is any condition which is not considered detrimental to an organism. For example, death induced in unwanted cells (e.g., tumor cells) is a normal condition. Likewise, angiogenesis induced at wound sites or other areas in which neovascularization is beneficial is a normal condition. A "pathologic condition" is any condition which is considered detrimental to the organism. For example, tumor growth or metastasis, or angiogenesis which damages surrounding tissues, are pathologic conditions.

The physiological state induced by the present methods can also be the absence or inhibition of a normal or pathologic condition. For example, the induced physiological state can be the inhibition of tumor growth or metastasis. The induced physiological state can also be the inhibition or elimination of angiogenesis.

As used herein, a "target cell" includes any cell which can be treated to express at least one gene while reducing the expression of at least another gene for certain cellular factors. A gene is "expressed" in a target cell when RNA transcripts are produced in that cell which themselves have functionality (either with or without processing), or which are subsequently translated into a functional protein. Expression of a gene in a target cell can be detected directly; i.e., by detecting the presence of RNA transcripts or protein produced from the gene. Gene expression in a target cell can also be inferred from a change in cell phenotype which is expected to occur upon expression of the gene.

Expression of a gene in a target cell is "reduced" when there is a decrease in the amount of RNA transcripts produced from that gene in the target cell. In the practice of the present invention, gene expression is decreased by inducing RNAi of the gene in a target cell. Reduction of gene expression in a target cell can be determined by measuring the amount of RNA transcripts or protein produced from that gene after inducing RNAi, as compared to the amount of RNA transcripts or protein produced in the cell prior to treatment. Alternatively, the amount of RNA transcripts or protein produced in a target cell can be compared to the amount of RNA transcripts produced in an untreated target cell. Treatments suitable for inducing RNAi of a gene in a target cell are described in more detail below.

The level of a cellular factor in a target cell is "increased" after treatment when the amount of that factor present in the target cell is greater than the amount present in the cell before treatment. Alternatively, the amount of cellular factor present in the target cell after treatment can be compared to the amount of cellular factor present in an untreated target cell. Treatments suitable for increasing the level of a cellular factor in a target cell are described in more detail below.

As used herein, an "untreated target cell" refers to a cell which has not undergone treatment to reduce expression of cellular factor genes or to increase the amount of cellular factor inside the cell, but which is of the same type as the target cell. For example, if the target cell is a retinal pigment epithelial cell in a subject suffering from AMD, an untreated target cell can be a retinal pigment epithelial cell from an individual who is not suffering from AMD. The untreated target cell can be located in vivo or in vitro. Preferably, the untreated target cell is a cultured cell of the same type as the target cell. In one embodiment, the untreated target cell can be a retinal pigment epithelial cell. In another embodiment, the untreated target cell can be a tumor cell.

The level of gene expression in untreated target cells can be pre-determined, and used for subsequent comparison to the level of gene expression in target cells. One skilled in the art can readily determine the level of expression of cellular factor genes in an untreated target cell using standard molecular biology techniques. More conveniently, reduction in gene expression in a target cell can be inferred from a change in cell phenotype which is expected to occur upon reducing expression of the gene.

As used herein, a "gene" includes any nucleic acid sequence which encodes an RNA transcript that is itself a functional agent (such as in siRNA or micro RNA), or which is subsequently translated into a protein. A gene can comprise at least one promoter and termination signals operably linked to the nucleic acid sequence which encodes an RNA transcript. "Operably linked" refers to two or more nucleic acid sequences that are related physically or functionally. For example, a promoter is said to be "operably linked" to a DNA sequence that codes for an RNA, if the two sequences are situated such that the promoter affects the expression level of the DNA sequence. For purposes of the present invention, a gene can comprise a constitutive promoter, or can comprise an inducible promoter which initiates transcription only when the target is exposed to some particular external stimulus.

It is understood that a gene can comprise an uninterrupted nucleic acid sequence for encoding an RNA transcript, such as a cDNA sequence. A gene can also comprise an interrupted nucleic acid sequence encoding an RNA transcript that is processed. For example, a gene can comprise a nucleic acid sequence with intronic and exonic sequences. Genes can be located in the genome of a cell, or can be introduced into the cell, for example on an expression vector such as a plasmid or cosmid. The gene can be one which is naturally occurring, but which has been obtained in a recombinant form useful for expression in target cells.

In one embodiment, target cells are treated with compounds designed to reduce expression of at least one gene which encodes a cellular factor that promotes angiogenesis (hereinafter called a "pro-angiogenic gene"), and are also treated to increase the level of a cellular factor encoded by at least one gene which inhibits angiogenesis (hereinafter called a "anti-angiogenic gene"). Cellular factors encoded by pro-angiogenic genes are "pro-angiogenic factors." Cellular factors encoded by anti-angiogenic genes are "anti-angiogenic factors."

Pro-angiogenic genes include those listed in Table 1. The SEQ ID NOS. which correspond to the messenger RNA (mRNA) sequences encoding the corresponding pro-angiogenic factors are also given in Table 1.

TABLE 1

| Pro-Angiogenic Genes | | | |
|---|---|---|---|
| Reference[1] | Pro-Angiogenic Gene | Organism | SEQ ID NO: |
| GenBank AF214570 | $VEGF_{121}$ (vascular endothelial growth factor isoform 121) | Homo sapiens | 1 |
| GenBank AF486837 | $VEGF_{165}$ (isoform 165) | Homo sapiens | 2 |
| | $VEGF_{189}$ (isoform 189) | Homo sapiens | 3 |
| | $VEGF_{206}$ (isoform 206) | Homo sapiens | 4 |
| | VEGF | Mus musculus | 5 |
| | Flt-1 (VEGF receptor 1) | Homo sapiens | 6 |
| | Flk-1/KDR (VEGF receptor 2) | Homo sapiens | 7 |
| Semenza G L (1999), Ann. Rev. Cell. Dev. Biol. 15: 551-578 | HIF-1 alpha (hypoxia inducible factor 1 alpha subunit) | Homo sapiens | 8 |
| GenBank NM_001530 | HIF-1 alpha splice variant 1 | Homo sapiens | 9 |
| GenBank NM_181054 | HIF-1 alpha splice variant 2 | Homo sapiens | 10 |
| GenBank NM_024359 | HIF-1 alpha | Rattus norvegicus | 11 |
| GenBank NM_010431 | HIF-1 alpha | Mus musculus | 12 |

TABLE 1-continued

Pro-Angiogenic Genes

| Reference[1] | Pro-Angiogenic Gene | Organism | SEQ ID NO: |
|---|---|---|---|
| GenBank XM_049518 | ICAM-1 (inter-cellular adhesion molecule 1) | Homo sapiens | 13 |
| GenBank NM_010493 | ICAM-1 | Mus musculus | 14 |
| GenBank AY124380 | Ang1 (angiopoeitin 1) | Homo sapiens | 15 |
| GenBank AY121504 | Ang1 splice variant | Homo sapiens | 16 |
| GenBank AF345932 | Ang1 | Canis familiaris | 17 |
| GenBank NM_00147 | Ang2 (angiopoeitin 2) | Homo sapiens | 18 |
| GenBank AF187858 | Ang2 splice variant | Homo sapiens | 19 |
| GenBank NM_007426 | Ang2 | Mus musculus | 20 |
| GenBank L06139 | Tie2 (tyrosine kinase with immunoglobulin and epidermal growth factor homology domains 2) | Homo sapiens | 21 |
| GenBank AB086825 | Tie2 splice variant | Homo sapiens | 22 |
| GenBank AX398356 | Tie2 mutant | Homo sapiens | 23 |
| GenBank NM_013690 | Tie2 | Mus musculus | 24 |
| GenBank NW_043856 | Tie2 | Rattus norvegicus | 25 |

[1]All documents listed in Table 1 are herein incorporated by reference in their entirety.

Anti-angiogenic genes include those listed in Table 2. The nucleic acid sequences encoding the corresponding anti-angiogenic factors and the amino acid sequences of these factors, are given in the sequence listing as indicated in Table 2. Table 2 and the nucleic acid and amino acid sequences referred to therein are adapted from information provided on the website maintained by InvivoGen (San Diego, Calif. 92121).

TABLE 2

Anti-Angiogenic Factors

| Reference[2] | Anti-Angiogenic Gene | Organism | SEQ ID NO: nucleotide | SEQ ID NO: protein |
|---|---|---|---|---|
| Jones N et al. (2001), Nat Rev Mol Cell Biol 2(4): 257-67 | Ang2 (Angiopoietin-2) | Homo sapiens | 26 | 27 |
| | | Mus musculus | 28 | 29 |
| Tanaka T et al. (1998), Cancer Res 58: 3362-3369. | Angiostatin (internal fragment of human plasminogen) | Homo sapiens | 30 | 31 |
| | | Mus musculus | 32 | 33 |
| O'Reilly et al. (1999), Science 285: 1926-1928. | AntiThrombin-3 | Homo sapiens | 34 | 35 |
| | | Mus musculus | 36 | 37 |
| Hong L et al (1999), Hum Gene Ther 10: 3045-3053. | ATF (Amino-terminal fragment of Urokinase) | Homo sapiens | 38 | 39 |
| | | Mus musculus | 40 | 41 |
| Pike S E et al. (1999), Blood 94(7): 2461-8 | Calreticulin and Calreticulin fragments | Homo sapiens | 42 | 43 |
| | | Mus musculus | 44 | 45 |
| Sasaki T et al. (2000), J Mol Biol 301(5): 1179-90 | Endostatin XV (collagen XV C-term fragment) | Homo sapiens | 46 | 47 |
| | | Mus musculus | 48 | 49 |
| | Endostatin VIII (collagen XVIII C-term fragment) | Homo sapiens | 50 | 51 |
| | | Mus musculus | 52 | 53 |
| Sgadari, S et al. (1996), Proc Natl Acad Sci USA 93: 13791-13796 | IP-10 (Interferon-alpha Inducible Protein 10) | Homo sapiens | 54 | 55 |
| | | Mus musculus | 56 | 57 |
| Cao R et al. (1999), Proc Natl Acad Sci USA 96: 5728-33 | K1-5 (The 5 Kringle domains of human plasminogen) | Homo sapiens | 58 | 59 |
| | | Mus musculus | 60 | 61 |
| Ji W R et al. (1998), Biochem Biophys Res Commun 247: 414-419. | Kringle-5 domain of human plasminogen | Homo sapiens | 62 | 63 |
| Zhang M et al. (2000), Nat Med 6: 196-9 | Maspin (Mammary serine protease inhibitor or PI5) | Mus musculus | 64 | 65 |
| Sgadari C et al. (1997), Blood 89: 2635-2643 | Mig/CXCL9 (Monokine-induced by Interferon-gamma) | Homo sapiens | 66 | 67 |
| | | Mus musculus | 68 | 69 |
| Dawson D W et al. (1999), Science 285: 245-8 | PEDF (Pigment Epithelium-Derived Factor) | Homo sapiens | 70 | 71 |
| | | Mus musculus | 72 | 73 |
| Brooks P C et al. (1998), Cell 92: 391-400 | PEX (C-term hemopexin domain of MMP-2) | Homo sapiens | 74 | 75 |
| | | Mus musculus | 76 | 77 |
| Tanaka T et al. (1997), Nat Med 3: 437-442. | CXCL4 (Platelet Factor 4) | Homo sapiens | 78 | 79 |
| | | Mus musculus | 80 | 81 |
| Bengtson N W et al. (2000), Mol Endocrinol 14: 1934-43 | PRP (Proliferin-Related Protein) | Mus musculus | 82 | 83 |
| Martin D C (1996), Oncogene 13: 569-576. | TIMP-1 (Tissue inhibitor of metalloproteinase-1) | Homo sapiens | 84 | 85 |
| | | Mus musculus | 86 | 87 |
| Valente P et al. (1998), Int J Cancer 75: 246-253 | TIMP-2 (Tissue inhibitor of metalloproteinase-2) | Homo sapiens | 88 | 89 |

TABLE 2-continued

Anti-Angiogenic Factors

| | | | SEQ ID NO: | |
|---|---|---|---|---|
| Reference[2] | Anti-Angiogenic Gene | Organism | nucleotide | protein |
| Spurbeck W W et al. (2003), Cancer Gene Therapy 10: 161-167 | TIMP-3 (Tissue inhibitor of metalloproteinase-3) | Homo sapiens Mus musculus | 90 92 | 91 93 |
| Greene J et al. (1996), J Biol Chem 271: 30375-30380 | TIMP-4 (Tissue inhibitor of metalloproteinase-4) | Homo sapiens | 94 | 95 |
| Moses M A. (1999), Proc Natl Acad Sci USA 96: 2645-2650 | Troponin I-2 (fast-twitch skeletal muscle) | Homo sapiens Mus musculus | 96 98 | 97 99 |
| Wakasugi K et al. (2002), Proc Natl Acad Sci USA 99: 173-7 | T2-TrpRs (Ser94-Gln471 fragment of Tryptophanyl-tRNA synthetase) | Homo sapiens | 100 | 101 |
| Iruela-Arispe M L et al. (1999), Circulation 100: 1423-31 | TSP-1 (Thrombospondin-1) | Homo sapiens | 102 | 103 |
| Maeshima Y. et al. (2001), J Biol Chem 276: 15240-8 | Tumstatin (Collagen IV fragment; NC1 domain of alpha-3 chain) | Homo sapiens | 104 | 105 |

[2]All documents listed in Table 2 are herein incorporated by reference in their entirety.

According to the present invention, expression of pro-angiogenic genes is reduced in target cells by inducing RNAi-mediated destruction of mRNA produced from one or more pro-angiogenic genes. For example, the expression of VEGF gene, or a VEGF gene and a HIF-1 alpha gene, can be reduced in a target cell by RNAi. The expression of other combinations of pro-angiogenic genes can also be reduced in a target cell by RNAi; for example, the expression of VEGF/Ang2; VEGF/ICAM-1; or VEGF/HIF-1 alpha/Ang2 can be reduced.

RNAi can be induced in a target cell by treating that cell with an isolated double-stranded RNA ("dsRNA") molecule which has at least about 90%, for example about 95%, about 98%, about 99% or about 100%, sequence homology with at least a portion of the mRNA produced from the pro-angiogenic gene. The dsRNA molecule can be any size which induces RNAi of the pro-angiogenic gene in a target cell, but is preferably between about 15 base pairs to about 500 base pairs in length. In a particularly preferred embodiment, the dsRNA molecule is a "short or small interfering RNA" or "siRNA."

As used herein, an "isolated" molecule is a molecule which is synthetic, or which is altered or removed from the natural state through human intervention. For example, a dsRNA or protein naturally present in a living animal is not "isolated," but a synthetic dsRNA or protein, or a dsRNA or protein which is partially or completely separated from the coexisting materials of its natural state, is "isolated." An isolated dsRNA or protein can exist in substantially purified form, or can exist in a non-native environment such as, for example, a cell into which the dsRNA or protein has been introduced. Molecules which are produced inside a cell by natural processes, but which are produced from an "isolated" precursor molecule, are also considered to be "isolated" molecules. For example, an isolated dsRNA or protein can be introduced into a target cell, where it is processed by the Dicer protein (or its equivalent) into siRNA. The siRNA produced from the original isolated dsRNA inside the cell are considered isolated molecules for purposes of the present invention. RNA transcripts and/or protein produced from an expression vector inside a cell are also considered to be "isolated" molecules.

As used herein, a target cell is "treated" a with a dsRNA molecule when that dsRNA molecule is introduced into a target cell. A dsRNA can be introduced into a target cell by any suitable molecular biology technique, including direct administration to the cells, administration in conjunction with a nucleic acid delivery reagent, or transfection of the cell with an expression vector comprising nucleic acid sequences encoding the dsRNA molecule. Techniques for introducing dsRNA into target cells, including the construction and use of expression vectors for introducing the dsRNA, are discussed in more detail below.

siRNA useful in the present methods can comprise short double-stranded RNA from about 17 nucleotides to about 29 nucleotides in length, preferably from about 19 to about 25 nucleotides in length, particularly preferably 21 nucleotides in length. The siRNA are targeted to mRNA produced from cellular factor genes such as pro-angiogenic or anti-apoptotic genes. The mRNA produced from such cellular factor genes is also referred to herein as "target mRNA."

The siRNA comprise a sense RNA strand and a complementary antisense RNA strand annealed together by standard Watson-Crick base-pairing interactions (hereinafter "base-paired"). The sense strand comprises a nucleic acid sequence which is substantially identical to a target sequence contained within the target mRNA.

As used herein, a nucleic acid sequence in an siRNA which is "substantially identical" to a target sequence contained within the target mRNA is a nucleic acid sequence which is identical to the target sequence, or which differs from the target sequence by one, two or more nucleotides. siRNA comprising sense strands which comprise nucleic acid sequences that are "substantially identical" to a target sequence are characterized in that they induce RNAi-mediated degradation of mRNA containing the target sequence. For example, an siRNA of the invention can comprise a sense strand comprising nucleic acid sequences which differ from a target sequence (e.g., by one or two nucleotides), provided that RNAi-mediated degradation of the target mRNA is induced by the siRNA.

The sense and antisense strands of the siRNA can comprise two complementary, single-stranded RNA molecules, or can comprise a single molecule in which two complementary portions are base-paired and are covalently linked by a single-stranded "hairpin" area. Without wishing to be bound by any theory, it is believed that the hairpin area of the latter type of siRNA molecule is cleaved intracellularly by the Dicer protein (or its equivalent) to form an siRNA of two individual base-paired RNA molecules. The siRNA can also contain alterations, substitutions or modifications of one or more ribonucleotide bases. For example, the siRNA can be altered, substituted or modified to contain one or more deoxyribonucleotide bases.

The siRNA of the invention can comprise partially purified RNA, substantially pure RNA, synthetic RNA, or recombinantly produced RNA, as well as altered RNA that differs from naturally-occurring RNA by the addition, deletion, substitution and/or alteration of one or more nucleotides. Such alterations can include addition of non-nucleotide material, such as to the end(s) of the siRNA or to one or more internal nucleotides of the siRNA; or modifications that make the siRNA more resistant to nuclease digestion. Suitable modifications to increase the nuclease resistance of the present siRNA include the use of 2'-OH substituted ribonucleotides, such as 2'-O-alkylated (e.g., 2'-O-methylated) or 2'-halogenated (e.g., F, Cl, Br, or I) ribonucleotides; modifications to the sugar phosphate backbone (e.g., phoshporothioate, phosphorodithioate, and methylphosphonate linkages); or the substitution of one or more nucleotides in the siRNA with deoxyribonucleotides. Modifications that make the siRNA resistant to nuclease digestion are known in the art; see, e.g., US 2003/0206887 to Morissey et al., the entire disclosure of which is herein incorporated by reference. The siRNA of the invention which are exposed to serum, lachrymal fluid or other nuclease-rich environments, or which are delivered topically (e.g., by eyedropper), are preferably modified to increase their resistance to nuclease digestion.

One or both strands of the siRNA of the invention can also comprise a 3' overhang. As used herein, a "3' overhang" refers to at least one unpaired nucleotide extending from the 3'-end of a duplexed RNA strand.

Thus in one embodiment, the siRNA comprises at least one 3' overhang of from 1 to about 6 nucleotides (which can include ribonucleotides or deoxyribonucleotides) in length, preferably from 1 to about 5 nucleotides in length, more preferably from 1 to about 4 nucleotides in length, and particularly preferably from about 2 to about 4 nucleotides in length.

In the embodiment in which both strands of the siRNA molecule comprise a 3' overhang, the length of the overhangs can be the same or different for each strand. In a most preferred embodiment, the 3' overhang is present on both strands of the siRNA, and is 2 nucleotides in length. For example, each strand of the siRNA can comprise 3' overhangs of dithymidylic acid ("TT") or diuridylic acid ("uu").

In order to enhance the stability of the present siRNA, the 3' overhangs can be also stabilized against degradation. In one embodiment, the overhangs are stabilized by including purine nucleotides, such as adenosine or guanosine nucleotides. Alternatively, substitution of pyrimidine nucleotides by modified analogues; e.g., substitution of uridine nucleotides in the 3' overhangs with 2'-deoxythymidine, is tolerated and does not affect the efficiency of RNAi degradation. In particular, the absence of a 2' hydroxyl in the 2'-deoxythymidine significantly enhances the nuclease resistance of the 3' overhang in tissue culture medium.

In certain embodiments, the siRNA comprise the sequence AA(N19)TT (SEQ ID NO: 1738) or NA(N21), where N is any nucleotide. These siRNA comprise approximately 30-70% G/C, and preferably comprise approximately 50% G/C. The sequence of the sense siRNA strand corresponds to (N19)TT or N21 (i.e., positions 3 to 23), respectively. In the latter case, the 3' end of the sense siRNA is converted to TT.

The rationale for this sequence conversion is to generate a symmetric duplex with respect to the sequence composition of the sense and antisense strand 3' overhangs. The antisense strand is then synthesized as the complement to positions 1 to 21 of the sense strand.

Because position 1 of the 23-nt sense strand in these embodiments is not recognized in a sequence-specific manner by the antisense strand, the 3'-most nucleotide residue of the antisense strand can be chosen deliberately. However, the penultimate nucleotide of the antisense strand (complementary to position 2 of the 23-nt sense strand in either embodiment) is generally complementary to the targeted sequence.

In another embodiment, the siRNA can comprise the sequence NAR(N17)YNN, where R is a purine (e.g., A or G) and Y is a pyrimidine (e.g., C or U/T). The respective 21-nt sense and antisense strands of this embodiment therefore generally begin with a purine nucleotide. Such siRNA can be expressed from pol III expression vectors without a change in targeting site, as expression of RNAs from pol III promoters is only believed to be efficient when the first transcribed nucleotide is a purine.

The siRNA can be targeted to any stretch of approximately 19-25 contiguous nucleotides in any of the target mRNA sequences (the "target sequence"). Techniques for selecting target sequences for siRNA are given, for example, in Tuschl T et al., "The siRNA User Guide," revised Oct. 11, 2002, the entire disclosure of which is herein incorporated by reference. "The siRNA User Guide" is available on the world wide web at a website maintained by Dr. Thomas Tuschl, Department of Cellular Biochemistry, AG 105, Max-Planck-Institute for Biophysical Chemistry, 37077 Göttingen, Germany, and can be found by accessing the website of the Max Planck Institute and searching with the keyword "siRNA." Thus, the sense strand of the present siRNA comprises a nucleotide sequence identical to any contiguous stretch of about 19 to about 25 nucleotides in the target mRNA.

Generally, a target sequence on the target mRNA can be selected from a given cDNA sequence corresponding to the target mRNA, preferably beginning 50 to 100 nucleotides downstream (i.e., in the 3' direction) from the start codon. The target sequence can, however, be located in the 5' or 3' untranslated regions, or in the region nearby the start codon. For example, a suitable target sequence in the human $VEGF_{121}$ mRNA sequence is (represented as cDNA):

(SEQ ID NO:106)
TCATCACGAAGTGGTGAAG

Thus, an siRNA targeting this sequence, and which has 3' uu overhangs on each strand (overhangs shown in bold), is:

(SEQ ID NO:107)
5'-ucaucacgaaguggugaaguu-3'

(SEQ ID NO:108)
3'-uuaguagugcuucaccacuuc-5'

An siRNA targeting this same sequence, but having 3' TT overhangs on each strand (overhangs shown in bold) is:

(SEQ ID NO:109)
5'-ucaucacgaaguggugaagTT-3'

(SEQ ID NO:110)
3'-TTaguagugcuucaccacuuc-5'

Representative target sequences for the pro-angiogenic genes listed above, from which siRNA of the invention can be derived, are given in the sequence listing. For example, representative target sequences for human VEGF are given in SEQ ID NOS. 111-183. Representative target sequences for human HIF-1 alpha are given in SEQ ID NOS. 184-458. Representative target sequences for human Flt-1 and Flk-1/KDR are given in SEQ ID NOS. 459-872 and 873-1232, respectively. Representative target sequences for human ICAM-1 are given in SEQ ID NOS. 1233-1307. Representative target sequences for human Ang1 are given in SEQ ID NOS. 1308-1503. Representative target sequences for human Ang2 are given in SEQ ID NOS. 1504-1703. The construction of siRNA comprising these target sequences is within skill in the art.

The dsRNA for use in the present methods can be obtained using techniques within the skill in the art. For example, dsRNA can be chemically synthesized using appropriately protected ribonucleoside phosphoramidites and a conventional DNA/RNA synthesizer. dsRNA can also be produced from an expression vector, as discussed in more detail below. siRNA can also be chemically synthesized or recombinantly produced using methods known in the art, such as the *Drosophila* in vitro system described in U.S. published application 2002/0086356 of Tuschl et al., the entire disclosure of which is herein incorporated by reference. dsRNA can be synthesized as two separate, complementary RNA molecules, or as a single RNA molecule with two complementary regions. Commercial suppliers of synthetic RNA molecules or synthesis reagents include Proligo (Hamburg, Germany), Dharmacon Research (Lafayette, Colo., USA), Pierce Chemical (part of Perbio Science, Rockford, Ill., USA), Glen Research (Sterling, Va., USA), ChemGenes (Ashland, Mass., USA) and Cruachem (Glasgow, UK).

Preferably, the dsRNA (in particular siRNA) are expressed from recombinant circular or linear DNA expression vectors. As used herein, "expression vectors" are constructs that comprise suitable nucleic acid sequences for expression of dsRNA. Preferably, the expression vector comprises a plasmid vector. However, the expression vector can be any construct suitable for introduction into a prokaryotic or eukaryotic cell which is known in the art, for example a cosmid, artificial chromosome or viral vector.

Construction of expression vectors for expressing dsRNA is within the skill in the art, as exemplified by J. Sambrook et al., *Molecular Cloning, A Laboratory Manual* (2d Ed. 1989) (Cold Spring Harbor Laboratory). For example, nucleic acid sequences comprising the various components of an expression vector can be introduced consecutively by restriction enzyme cleavage of an appropriate base vector, and insertion of the component into the restriction site of the vector. After ligation and cloning of the components into the base vector to form the expression vector, the expression vector can be replicated in a appropriate host cell and isolated for further use.

Particularly preferred are bacterial plasmid expression vectors which utilize regulatory systems compatible with *E. coli* or other bacterial strains. For example, *E. coli* can be transformed using derivatives of pBR322, a plasmid derived from an *E. coli* species by Bolivar et al. (1977), Gene 2: 95. Plasmid pBR322 contains genes for ampicillin and tetracycline resistance, and thus provides multiple selectable markers which can be either retained or destroyed in constructing the desired vector. Other suitable plasmid vectors include plasmids pUC9-TSF11 and pUC9delH3-pTSF-3. These plasmids are derived from pUC9 (Messing and Vieira (1982), *Gene* 19: 259-268), which contains parts of pBR322.

Commonly used prokaryotic regulatory sequences suitable for constructing plasmid vectors include bacterial promoters for transcription initiation, optionally with an operator, and ribosome binding site sequences. Commonly used promoters include the lactamase (penicillinase) and lactose (lac) promoter systems (Chang et al. (1977), *Nature* 198: 1056); the tryptophan (trp) promoter system (Goeddel et al. (1980), *Nucl. Acids Res.* 8: 4057); the lambda-derived $P_L$ promoter (Shimatake et al. (1981), *Nature* 292: 128); and the trp-lac (trc) promoter system (Amann and Brosius (1985), *Gene* 40: 183), the entire disclosures of which are herein incorporated by reference.

Other components for constructing suitable plasmid vectors are available, typically carried in other plasmids. These components can be excised from their source plasmids and ligated together with the nucleic acid sequence of interest, using standard restriction and ligation procedures.

Figure 1B:
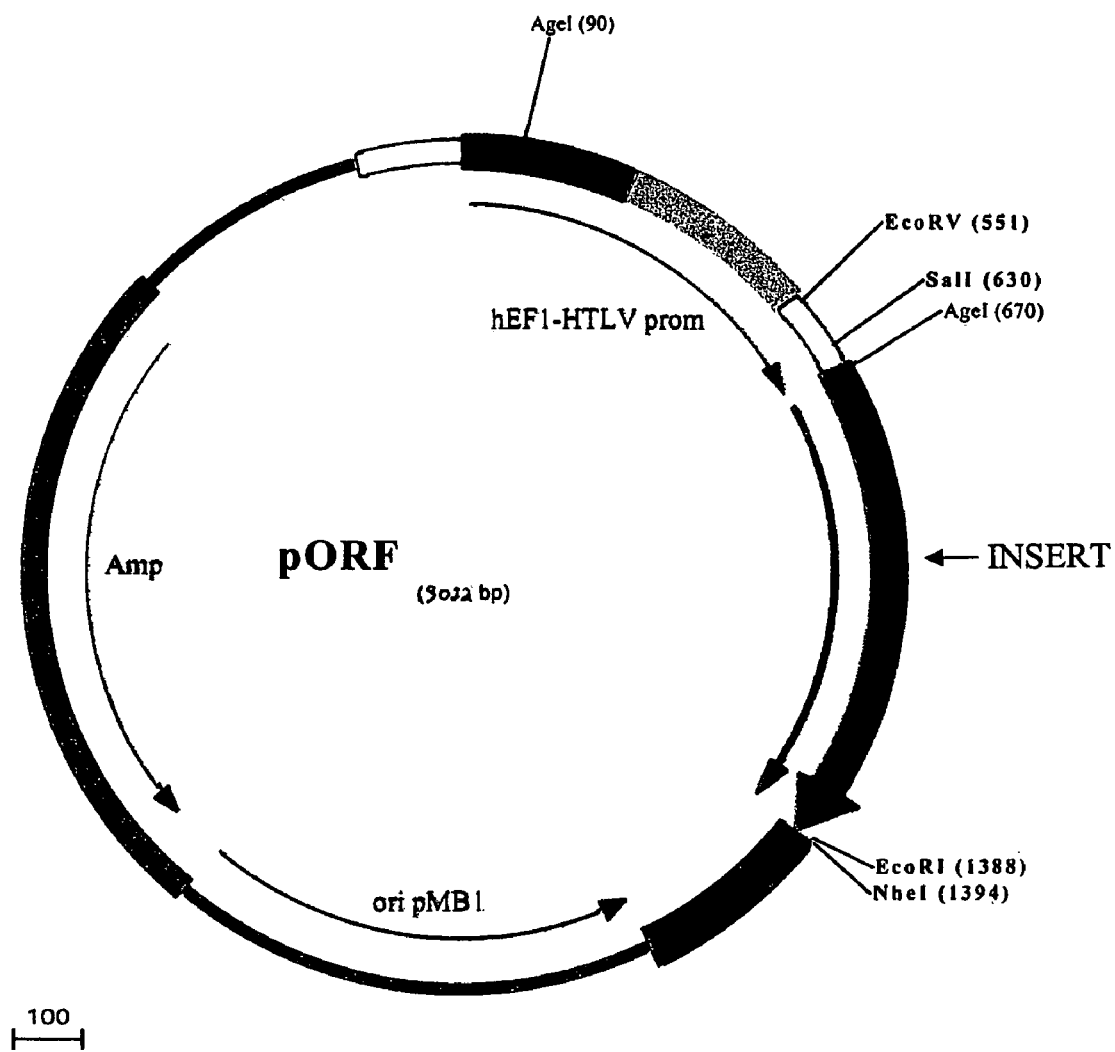
Figure 1C:
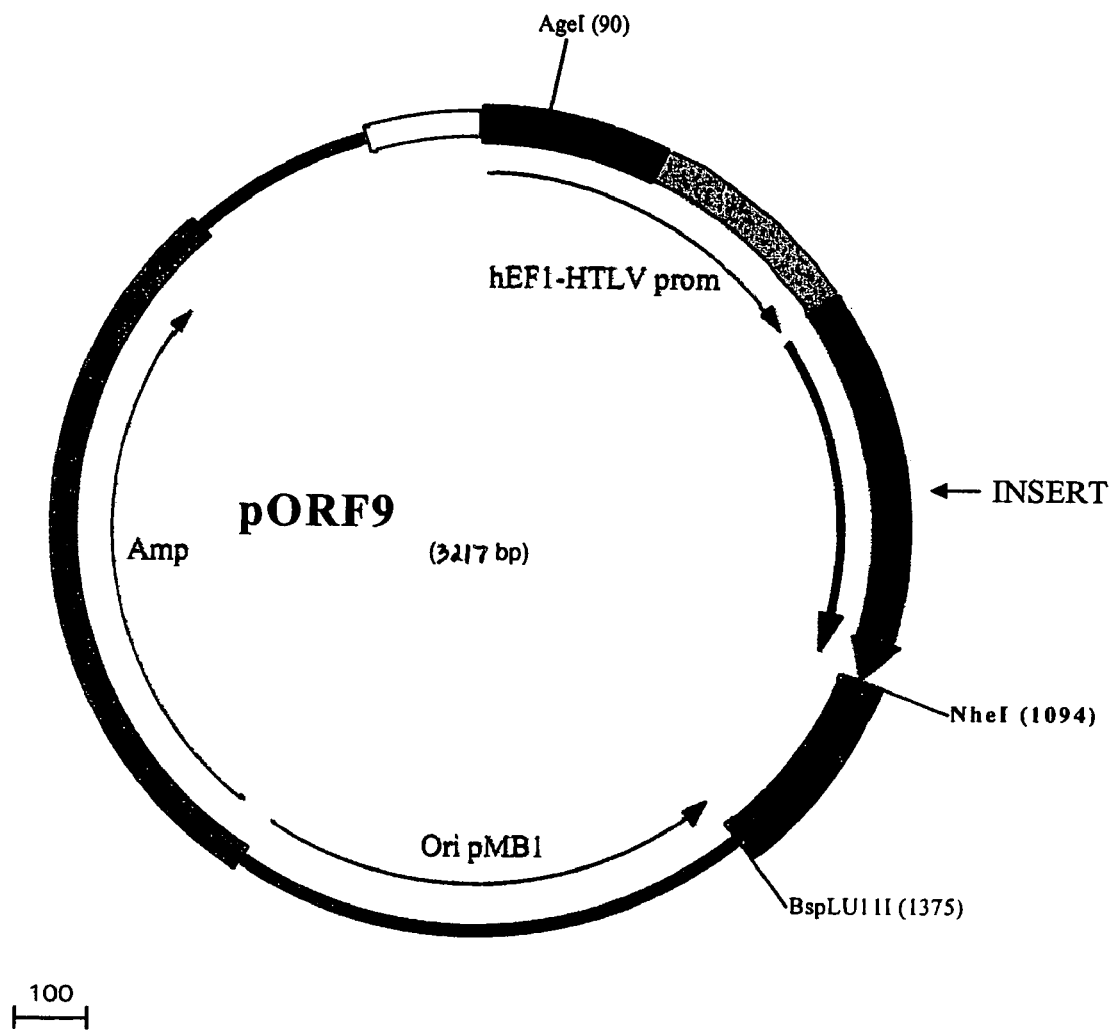

Commercially available plasmid vectors are suitable for use in the invention; for example, the plasmids pBLAST (and its derivatives such as pBLAST40, pBLAST45 and pBLAST49); pORF and pORF9 (see FIGS. 1A-1C) can be obtained from InvivoGen (San Diego, Calif. 92121). The pBLAST plasmids contain an EF-1a composite promoter that consists of the elongation factor 1 alpha core promoter fused to the 5' UTR of the HTLV or eIF4G gene. The composite promoter in the pBLAST plasmids yield high levels of gene expression in a wide variety of cell lines. The pORF plasmid contains the EF-1a/HTLV composite promoter in tandem with a bacterial promoter within an intron called 1117. The pORF9 plasmid contains the EF-1a/HTLV composite promoter and no bacterial promoter. Nucleic acid sequences to be expressed (indicated as "insert" in FIGS. 1A-1C) can be inserted into the multiple cloning sites of these vectors (see FIGS. 1A-1C) using standard molecular biology techniques such as site-specific nucleic acid cleavage and ligation.

Site-specific nucleic acid cleavage, or restriction, is generally performed by treating nucleic acid sequences with suitable restriction enzyme(s) under conditions well-known in the art. Moreover, suitable reaction conditions for a given restriction enzyme are typically specified by the manufacturer of commercially available restriction enzymes. See, e.g., New England Biolabs Product Catalog, 2001.

In general, about 1 microgram of plasmid or nucleic acid sequence is cleaved by one unit of restriction enzyme in about 20 microliter of buffer solution. An excess of restriction enzyme is often used to insure complete digestion of the nucleic acid substrate. Incubation times of about one hour to two hours at about 37° C. are generally used, although variations can be tolerated, and certain restriction enzymes require higher or lower incubation temperatures.

After each incubation, restriction enzyme can be inactivated and removed from the nucleic acid sequence by extraction with phenol/chloroform, optionally followed by ether extraction, and the nucleic acid recovered from aqueous fraction by precipitation with 2 to 2½ volumes of ethanol. If desired, size separation of the cleaved nucleic acid fragments may be performed by polyacrylamide or agarose gel electrophoresis using standard techniques. A general description of size separation techniques is found in *Methods in Enzymology* (1980), 65: 499-560, the entire disclosure of which is herein incorporated by reference.

Many restriction enzymes leave single-stranded overhangs after cleavage of nucleic acid sequences. Nucleic acid fragments with single-stranded overhangs may be ligated with sequences containing complementary overhangs (so called "sticky-end" ligation), or may be "blunt ended" for subsequent ligation with other blunt-ended nucleic acid sequences.

Nucleic acid fragments may be "blunt-ended" by, for example, incubation with the large fragment of *E. coli* DNA polymerase I (Klenow fragment) in the presence of the four deoxyribonucleotide triphosphates (dNTPs), using incubation times of about 15 to 25 min. at 20 to 25° C. in 50 mM Tris pH 7.6, 50 mM NaCl, 6 mM $MgCl_2$, 6 mM DTT and 0.1-1.0 mM dNTPs. The Klenow fragment fills in 5' single-stranded overhangs, but "chews back" protruding 3' single strands. After treatment with Klenow fragment, the reaction mixture containing the blunt-ended nucleic acid fragments is extracted with phenol/chloroform and ethanol precipitated. Treatment under appropriate conditions with S1 nuclease or BAL-31 results in hydrolysis of any remaining single-stranded portions.

Ligation of nucleic acid sequences can be performed in 15-50 microliter volumes under the following standard conditions and temperatures, for example, 20 mM Tris-HCl pH 7.5, 10 mM $MgCl_2$, 10 mM DTT, 33 microgram/ml BSA, 10 mM-50 mM NaCl, and either 40 micromolar ATP, 0.01-0.02 (Weiss) units T4 DNA ligase at 0° C. (for "sticky end" ligation) or 1 mM ATP, 0.3-0.6 (Weiss) units T4 DNA ligase at 14° C. (for "blunt end" ligation). Intermolecular "sticky end" ligations are typically performed at 33-100 micrograms/ml total DNA concentrations (5-100 nM total end concentration). Intermolecular blunt end ligations are typically performed at 1 micromolar total ends concentration.

To avoid unwanted self-ligation of the vector, fragments of nucleic acids used for vector construction are commonly treated with bacterial alkaline phosphatase (BAP) or calf intestinal alkaline phosphatase (CIP) in order to remove the 5' phosphates. Phosphatase reactions are typically conducted at pH 8 in approximately 10 mM Tris-HCl, 1 mM EDTA using about 1 unit of BAP or CIP per microgram of vector, at 60° C. for about one hour. Phosphatased nucleic acid fragments can be recovered by extraction with phenol/chloroform and ethanol precipitation as described above.

To verify correct construction of the plasmid vector, plasmids are transfected into a suitable host, amplified, extracted, and analyzed by sequence and/or restriction analysis as is known in the art. For example, any *E. coli* strain or other suitable host may be transfected with the finished plasmid according to known techniques. Successful transfectants are selected by ampicillin, tetracycline or other antibiotic resistance (or with other appropriate markers), as is understood in the art.

Expression vectors can be extracted from the transfectants according to known methods, for example the method of Clewell et al. (1969), *Proc. Natl. Acad. Sci.* (*USA*) 62: 1159, optionally following chloramphenicol amplification (see Clewell (1972), *J. Bacteriol.* 110: 667). See also Holmes et al. (1981), *Anal. Biochem.* 114: 193-197 and Birnboim et al. (1979), *Nucl. Acids Res.* 7: 1513-1523, the entire disclosures of which are herein incorporated by reference. Commercially available nucleic acid "mini-preps" can also be used, such as are available from Qiagen, Boehringer Mannheim, Stratagene, Invitrogen, and others.

Isolated expression vectors can be analyzed, for example, by hybridization to appropriate radiolabeled probes in a "dot blot" analysis (e.g., as described by Kafatos et al. (1977), *Nucl. Acid Res.* 7: 1541-1552); restriction enzyme analysis; or by nucleic acid sequencing (e.g., via the dideoxy nucleotide method of Sanger et al. (1977), *Proc. Natl. Acad. Sci.* (*USA*) 74: 5463, as further described by Messing et al. (1981), *Nucl. Acids Res.* 9: 309, or the method of Maxam et al. (1980), *Methods in Enzymology* 65: 499), the entire disclosures of which are herein incorporated by reference.

Both prokaryotic and eukaryotic systems can be used to express nucleic acid sequences encoding the dsRNA. Prokaryotic hosts are preferred, for example various strains of *E. coli*. However, other microbial strains may also be used. Plasmid vectors which contain replication sites, selectable markers and regulatory sequences derived from a species compatible with the host are preferred.

In addition to bacteria, eukaryotic microbes such as yeast can also be used as hosts. Laboratory strains of *Saccharomyces cerevisiae* (Baker's yeast) are preferred, although a number of other strains or species are commonly available. Vectors employing, for example, the 2µ origin of replication described in Broach (1983), *Meth. Enz.* 101: 307, or other yeast compatible origins of replication (see, for example, Stinchcomb et al. (1979), *Nature* 282: 39; Tschumper et al. (1980), *Gene* 10: 157; and Clarke et al. (1983), *Meth. Enz.* 101: 300) can be used. Regulatory sequences for yeast vectors include promoters for the synthesis of glycolytic enzymes (see Hess et al. (1968), *J. Adv. Enzyme Reg.* 7:149 and Holland et al. (1978), *Biochemistry* 17: 4900). Additional promoters known in the art include the promoter for 3-phosphoglycerate kinase (Hitzeman et al. (1980), *J. Biol. Chem.* 255: 2073). Other suitable yeast promoters, which have the additional advantage of transcription controlled by growth conditions and/or genetic background, include the promoter regions for alcohol dehydrogenase 2, isocytochrome C, acid phosphatase, degradative enzymes associated with nitrogen metabolism, the alpha factor system and enzymes responsible for maltose and galactose utilization. For yeast hosts, terminator sequences are desirable at the 3' end of the coding sequences. Such terminators are found in the 3' untranslated region following the coding sequences in yeast-derived genes. The disclosures of all citations in this paragraph are herein incorporated by reference in their entirety.

It is also possible to express nucleic acid sequences in eukaryotic host cell cultures derived from multicellular organisms. See, for example, U.S. Pat. No. 4,399,216 of Axel et al., the entire disclosure of which is herein incorporated by reference. These systems have the ability to splice out introns, and thus can be used directly to express genomic fragments. However, non-genomic (e.g., cDNA) sequences can also be expressed.

Useful mammalian host cell lines include VERO, HeLa, human embryonic kidney (HEK), baby hamster kidney (BHK), CV-1, COS (e.g., COS-7), MDCK, NIH 3T3, and Chinese hamster ovary (CHO) cell lines. Expression vectors for such cells preferably comprise promoters and regulatory sequences compatible with mammalian cells such as, for example, the SV40 early and late promoters (Fiers et al. (1978), *Nature* 273: 113), or other viral promoters such as those derived from polyoma, adenovirus, adeno-associated virus, bovine papilloma, or avian sarcoma viruses. The controllable promoter hMTII (Karin et al. (1982), *Nature* 299: 797-802) can also be used. The disclosures of all citations in this paragraph are herein incorporated by reference in their entirety.

Depending on the host cell used, transfection of the expression vector is accomplished using standard techniques appropriate to the cell. The calcium treatment employing calcium chloride, as described by Cohen (1972), *Proc. Natl. Acad. Sci. USA* 69: 2110, or the $RbCl_2$ method described in Maniatis et al., *Molecular Cloning: A Laboratory Manual* (1982), Cold Spring Harbor Press, p. 254 and Hanahan (1983), *J. Mol. Biol.* 166: 557-580, can be used for prokaryotes or other cells which contain substantial cell wall barriers. For cells without such cell walls (i.e., eukaryotic; for example mammalian cells), the calcium phosphate precipitation method of Graham and van der Eb (1978), Virology 52: 546, optionally as modified by Wigler et al. (1979), Cell 16: 777-785 can be used. Transformations into yeast can be carried out according to the method of Beggs (1978), Nature 275: 104-109. The disclosures of all citations in this paragraph are herein incorporated by reference in their entirety.

The desired nucleic acid coding sequence for insertion into a plasmid vector can be retrieved from available cDNA or genomic DNA libraries, or from available plasmids. Alternatively, the desired nucleic acid coding sequence can be synthesized in vitro starting from the individual nucleoside derivatives. For example, nucleic acid sequences of sizeable length, e.g., 500-1000 base pairs, can be prepared by synthesizing individual overlapping complementary oligonucleotides and filling in single stranded non-overlapping portions using DNA polymerase in the presence of the deoxyribonucleotide triphosphates. This approach has been used successfully in the construction of several genes of known sequence. See, for example, Edge (1981), Nature 292: 756; Nambair et al. (1984), Science 223: 1299; and Jay (1984), J. Biol. Chem. 259: 6311. The disclosures of all citations in this paragraph are herein incorporated by reference in their entirety.

Synthetic nucleic acid sequences can be prepared by, for example, the phosphotriester method as described in Edge et al., supra, and Duckworth et al. (1981), Nucl. Acids Res. 9: 1691; or the phosphoramidite method as described in Beaucage and Caruthers (1981), Tet. Letts. 22: 1859 and Matteucci and Caruthers (1981), J. Am. Chem. Soc. 103: 3185. The nucleic acid sequences can also be prepared using commercially available automated oligonucleotide synthesizers. The disclosures of all citations in this paragraph are herein incorporated by reference in their entirety.

Once obtained, expression vectors encoding one or more dsRNA of the invention can be delivered into target cells using techniques within the skill in the art. See, for example Tuschl, T. (2002), Nat. Biotechnol, 20: 446-448; Brummelkamp T R et al. (2002), Science 296: 550-553; Miyagishi M et al. (2002), Nat. Biotechnol. 20: 497-500; Paddison P J et al. (2002), Genes Dev. 16: 948-958; Lee N S et al. (2002), Nat. Biotechnol. 20: 500-505; and Paul C P et al. (2002), Nat. Biotechnol. 20: 505-508, the entire disclosures of which are herein incorporated by reference.

In one embodiment, the expression vector is a recombinant plasmid expression vector encoding one or more siRNA. For each siRNA expressed, the expression vector comprises a sense RNA strand coding sequence in operable connection with a polyT termination sequence under the control of a human U6 RNA promoter, and an antisense RNA strand coding sequence in operable connection with a polyT termination sequence under the control of a human U6 RNA promoter. As used herein, "in operable connection with a polyT termination sequence" means that the nucleic acid sequences encoding the sense or antisense strands are immediately adjacent to the polyT termination signal in the 5' direction. During transcription of the sense or antisense sequences from the plasmid, the polyT termination signals act to terminate transcription. As used herein, "under the control" of a promoter means that the nucleic acid sequences encoding the sense or antisense strands are located 3' of the promoter, so that the promoter can initiate transcription of the sense or antisense coding sequences. Other promoters suitable for expressing siRNA include the H1 RNA pol III promoter sequences, the cytomegalovirus promoter, and inducible or regulatable promoters for expression of the siRNA in a particular tissue or in a particular intracellular environment.

In another embodiment, the expression vector is a recombinant viral vector comprising sequences encoding one or more siRNA and any suitable promoter for expressing the dsRNA sequences. Suitable promoters include, for example, the U6 or H1 RNA pol III promoter sequences and the cytomegalovirus promoter. Selection of other suitable promoters is within the skill in the art. The recombinant viral vectors can also comprise inducible or regulatable promoters for expression of the siRNA in a particular tissue or in a particular intracellular environment.

Any viral vector capable of accepting the coding sequences for the siRNA molecule(s) to be expressed can be used, for example vectors derived from adenovirus (AV); adeno-associated virus (AAV); retroviruses (e.g., lentiviruses, Rhabdoviruses, murine leukemia virus); herpes virus, and the like. The tropism of the viral vectors can be modified by pseudotyping the vectors with envelope proteins or other surface antigens from other viruses, or by substituting different viral capsid proteins, as appropriate.

For example, lentiviral vectors of the invention can be pseudotyped with surface proteins from vesicular stomatitis virus (VSV), rabies, Ebola, Mokola, and the like. AAV vectors of the invention can be made to target different cells by engineering the vectors to express different capsid protein serotypes. For example, an AAV vector expressing a serotype 2 capsid on a serotype 2 genome is called AAV 2/2. This serotype 2 capsid gene in the AAV 2/2 vector can be replaced by a serotype 5 capsid gene to produce an AAV 2/5 vector. Techniques for constructing AAV vectors which express different capsid protein serotypes are within the skill in the art; see, e.g., Rabinowitz J E et al. (2002), J Virol 76:791-801, the entire disclosure of which is herein incorporated by reference.

Selection of recombinant viral vectors suitable for use in the invention, methods for inserting nucleic acid sequences for expressing the siRNA into the vector, and methods of delivering the viral vector to the cells of interest are within the skill in the art. See, for example, Domburg R (1995), Gene Therap. 2: 301-310; Eglitis M A (1988), Biotechniques 6: 608-614; Miller A D (1990), Hum Gene Therap. 1: 5-14; and Anderson W F (1998), Nature 392: 25-30, the entire disclosures of which are herein incorporated by reference.

Preferred viral vectors are those derived from AV and AAV. In a particularly preferred embodiment, the siRNA of the invention is expressed as two separate, complementary single-stranded RNA molecules from a recombinant AAV vector comprising, for example, either the U6 or H1 RNA promoters, or the cytomegalovirus (CMV) promoter.

A suitable AV vector for expressing the siRNA of the invention, a method for constructing the recombinant AV vector, and a method for delivering the vector into target cells, are described in Xia H et al. (2002), Nat. Biotech. 20: 1006-1010, the entire disclosure of which is herein incorporated by reference.

Suitable AAV vectors for expressing the siRNA of the invention, methods for constructing the recombinant AAV vector, and methods for delivering the vectors into target cells are described in Samulski R et al. (1987), J. Virol. 61: 3096-3101; Fisher K J et al. (1996), J. Virol, 70: 520-532; Samulski R et al. (1989), J. Virol. 63: 3822-3826; U.S. Pat. No. 5,252,479; U.S. Pat. No. 5,139,941; International Patent Application No. WO 94/13788; and International Patent Application No. WO 93/24641, the entire disclosures of which are herein incorporated by reference.

In the practice of the present method, target cells are treated with one or more isolated dsRNA comprising a target sequence for a cellular factor, such as a pro-angiogenic gene. Target cells include any cell which produces pro- and antiangiogenic factors, particularly cells at or near sites of neovascularization. Suitable target cells include epithelial cells (such as uterine, vascular and retinal pigment epithelial cells) and tumor cells. Preferred target cells are retinal pigment epithelial cells.

As used herein, a target cell is "treated" with a dsRNA by any technique suitable for exposing the target cells to the dsRNA such that the dsRNA enters the target cell. For example, target cells can be exposed to a dsRNA by administering the dsRNA to a subject as naked RNA or in conjunction with a delivery reagent, or as expression vectors which express the dsRNA. The expression vectors can be administered alone or in combination with a delivery agent. Expression vectors which comprise viral vectors can be delivered into a cell by infecting the target cell according to techniques within the skill in the art.

Suitable delivery reagents for dsRNA or expression vectors include the Mirus Transit TKO lipophilic reagent; lipofectin; lipofectamine; cellfectin; or polycations (e.g., polylysine), or liposomes. Hereinafter, compounds comprising isolated dsRNA of the invention or comprising expression vectors expressing dsRNA of the invention are referred to as "RNAi compounds."

A preferred delivery reagent for RNAi compounds is a liposome. Liposomes can aid in the delivery of RNAi compounds to a particular tissue, such as retinal or tumor tissue, and can also increase the blood half-life of the dsRNA. Liposomes suitable for use in the invention are formed from standard vesicle-forming lipids, which generally include neutral or negatively charged phospholipids and a sterol, such as cholesterol. The selection of lipids is generally guided by consideration of factors such as the desired liposome size and half-life of the liposomes in the blood stream. A variety of methods are known for preparing liposomes, for example as described in Szoka et al. (1980), $Ann. Rev. Biophys. Bioeng.$ 9: 467; and U.S. Pat. Nos. 4,235,871, 4,501,728, 4,837,028, and 5,019,369, the entire disclosures of which are herein incorporated by reference.

Preferably, the liposomes encapsulating RNAi compounds comprise a ligand molecule that can target the liposome to a particular cell or tissue at or near the site of angiogenesis. Ligands which bind to receptors prevalent in tumor or vascular endothelial cells, such as monoclonal antibodies that bind to tumor antigens or endothelial cell surface antigens, are preferred.

Particularly preferably, the liposomes encapsulating RNAi compounds are modified so as to avoid clearance by the mononuclear macrophage and reticuloendothelial systems, for example by having opsonization-inhibition moieties bound to the surface of the structure. In one embodiment, a liposome of the invention can comprise both opsonization-inhibition moieties and a ligand.

The RNAi compounds can be administered to a subject by any suitable parenteral or enteral administration routes. Suitable enteral administration routes include oral, rectal, or intranasal delivery. Suitable parenteral administration routes include intravascular administration (e.g. intravenous bolus injection, intravenous infusion, intra-arterial bolus injection, intra-arterial infusion and catheter instillation into the vasculature); peri- and intra-tissue administration (e.g., peri-tumoral and intra-tumoral injection, intra-retinal injection or subretinal injection); subcutaneous injection or deposition including subcutaneous infusion (such as by osmotic pumps); direct (e.g., topical) application to the area at or near the site of neovascularization, for example by a catheter or other placement device (e.g., a corneal pellet or a suppository, eye-dropper, or an implant comprising a porous, non-porous, or gelatinous material); and inhalation. Suitable placement devices include the ocular implants described in U.S. Pat. Nos. 5,902,598 and 6,375,972, and the biodegradable ocular implants described in U.S. Pat. No. 6,331,313, the entire disclosures of which are herein incorporated by reference. Such ocular implants are available from Control Delivery Systems, Inc. (Watertown, Mass.) and Oculex Pharmaceuticals, Inc. (Sunnyvale, Calif.).

In a preferred embodiment, injections or infusions of RNAi compounds are given at or near the site of neovascularization. For example, RNAi compounds can be delivered to retinal pigment epithelial cells in the eye. Preferably, RNAi compounds are administered topically to the eye, e.g. in liquid or gel form to the lower eye lid or conjunctival cul-de-sac, as is within the skill in the art (see, e.g., Acheampong A A et al, 2002, $Drug Metabol. and Disposition$ 30: 421-429, the entire disclosure of which is herein incorporated by reference).

For example, RNAi compounds can be administered topically to the eye in volumes of from about 5 microliters to about 75 microliters, for example from about 7 microliters to about 50 microliters, preferably from about 10 microliters to about 30 microliters. It is understood that topical instillation in the eye of RNAi compounds in volumes greater than 75 microliters can result in loss of dsRNA from the eye through spillage and drainage. The RNAi compounds are highly soluble in aqueous solutions. Thus, it is preferable to administer a high concentration of RNAi compounds (e.g., 100-1000 nM) by topical instillation to the eye in volumes of from about 5 microliters to about 75 microliters.

A particularly preferred parenteral administration route for RNAi compounds is intraocular administration. It is understood that intraocular administration of the RNAi compounds can be accomplished by injection or direct (e.g., topical) administration to the eye, as long as the administration route allows the RNAi compounds to enter the eye. In addition to the topical routes of administration to the eye described above, suitable intraocular routes of administration include intravitreal, intraretinal, subretinal, subtenon, peri- and retro-orbital, trans-corneal and trans-scleral administration. Such intraocular administration routes are within the skill in the art; see, e.g., and Acheampong A A et al, 2002, supra; and Bennett et al. (1996), $Hum. Gene Ther.$ 7: 1763-1769 and Ambati J et al., 2002, $Progress in Retinal and Eye Res.$ 21: 145-151, the entire disclosures of which are herein incorporated by reference.

In this embodiment, target cells are also treated to increase the level of at least one anti-angiogenic factor inside the cell. The level of anti-angiogenic factors inside a cell can be increased by up-regulating expression of one or more anti-angiogenic genes located inside the target cell. For example, an anti-angiogenic gene which is already part of the target cell genome can be stimulated to increase production of RNA transcripts from the gene, or by stabilizing the RNA transcripts produced by that gene.

The level of anti-angiogenic factors inside target cell can also be increased by introducing one or more isolated anti-angiogenic factors directly into target cells, for example by injecting an anti-angiogenic factor into tissue comprised by the target cells, or by administering an anti-angiogenic factor to a subject systemically, so that it is delivered to and taken up by the target cells.

The anti-angiogenic factors can be modified to facilitate uptake of the anti-angiogenic factors into the target cells. For example, the anti-angiogenic factors can be encapsulated in a liposome prior to being administered to a subject. The encapsulated compounds are delivered directly into the target cells by fusion of the liposome to the cell membrane. Reagents and techniques for encapsulating the present compounds in liposomes are well-known in the art, as described above, and include the ProVectin™ Protein Delivery Reagent from Imgenex.

The anti-angiogenic factors can also be modified by associating the compounds with a peptide leader sequence known as a "protein transduction domain" or "PTD." These sequences direct entry of the compound into abnormally proliferating cells by a process known as "protein transduction." See Schwarze et al. (1999), Science 285: 1569, the entire disclosure of which is herein incorporated by reference.

PTDs are well-known in the art, and can comprise any of the known PTD sequences, including arginine-rich sequences such as peptides of nine to eleven arginine residues optionally in combination with one to two lysines or glutamines as described in Guis et al. (1999), Cancer Res. 59: 2577-2580, the disclosure of which is herein incorporated by reference. Preferred PTDs are sequences of eleven arginine residues or the $NH_2$-terminal 11-amino acid protein transduction domain from the human immunodeficiency virus TAT protein. Preferably, the PTD is designed so that it is cleaved from the compound upon entry into the cell. A PTD can be located anywhere on the anti-angiogenic factor that does not disrupt the anti-angiogenic properties of the factor, but is preferably located at the N-terminal end.

Kits and methods for constructing fusion proteins comprising a protein of interest (e.g., an anti-angiogenic factor) and a PTD are known in the art; for example the TransVector™ system (Q-BIOgene), which employs a 16 amino acid peptide called "Penetratin™" corresponding to the Drosophila antennapedia DNA-binding domain; and the Voyager system (Invitrogen Life Technologies), which uses the 38 kDa VP22 protein from Herpes Simplex Virus-1.

The level of anti-angiogenic factors inside target cell can also be increased by introducing expression vectors which encode one or more anti-angiogenic factors into the target cell. Expression vectors are described above. The nucleic acid sequences encoding the anti-angiogenic factors referred to in Table 2 can be used to construct expression vectors which express these sequences, using standard molecular biology techniques as discussed above. Preferred expression vectors are plasmids and viral vectors, as described above.

In one embodiment, expression vectors expressing one or more anti-angiogenic factors is introduced into cells of a subject, so that those cells produce anti-angiogenic factor and secrete it into the vasculature. The secreted anti-angiogenic factor (which is considered to be "isolated") is then delivered to and taken up by the target cells. For example, an AV or AAV vector expressing an anti-angiogenic factor can be administered to the blood-stream of a subject such that the AV or AAV vector transduces the subject's hepatocytes. The transduced hepatocytes produce the anti-angiogenic factor into the blood-stream. The secreted anti-angiogenic factor can then travel to and be taken up by, for example, RPE cells. Techniques for transducing hepatocytes with AV or AAV vectors are within the skill in the art; see, e.g., Ferry N. et al. (1998), Hum. Gene Ther. 9: 1975, the entire disclosure of which is herein incorporated by reference.

As used herein, any compound used to increases the level of an anti-angiogenic factor in a target cell is called an "anti-angiogenic compound." Anti-angiogenic compounds include compounds comprising isolated anti-angiogenic factors, isolated anti-angiogenic factors comprising PTDs, or expression vectors expressing anti-angiogenic factors. As used herein, a target cell is "treated" to increase the level of anti-angiogenic factors by any technique suitable for exposing the target cells to anti-angiogenic compounds, which allows the anti-angio-genic compounds to enter the cell. Target cells can be exposed to the anti-angiogenic compounds through administration to a subject by any suitable enteral or parenteral route, as described above for administering RNAi compounds to a subject.

In one embodiment, target cells can be treated with an expression vector that expresses an anti-angiogenic factor by administering the expression vector to a subject alone or in combination with a delivery agent, as described above for the RNAi compounds. Expression vectors which comprise viral vectors can be delivered into a target cell by infecting the cell according to techniques within the skill in the art.

In the practice of the present methods, target cells can be treated with particular combinations of RNAi compounds and anti-angiogenic compounds. For example, target cells can be treated with RNAi compounds which inhibit VEGF gene expression, and with anti-angiogenic compounds that increase the amount of PEDF, endostatin and/or angiostatin in the target cell. Target cells can be treated with RNAi compounds which inhibit HIF-1 alpha gene expression, and with anti-angiogenic compounds that increase the amount of PEDF, endostatin and/or angiostatin in the target cell. Other combinations of RNAi compounds and anti-angiogenic compounds for treating target cells are contemplated.

In the practice of the present method, RNAi compounds and anti-angiogenic compounds are preferably administered to a subject by the same route. However, RNAi compounds and anti-angiogenic compounds can be administered by different routes. Also, RNAi compounds and anti-angiogenic compounds need not be administered simultaneously, as long as both are ultimately present in the target cells.

In a preferred embodiment, target cells are treated with a "combination expression vector," which is a single expression vector that expresses at least one siRNA and at least one gene encoding an anti-angiogenic factor. The combination expression vector comprises nucleic acid sequences encoding the sense and antisense strands of at least one siRNA targeted to a pro-angiogenic gene, and nucleic acid sequences encoding at least one anti-angiogenic factor. Constructing combination expression vectors is within the skill in the art, for example by employing the molecular biology techniques described above. The construction and use of exemplary combination vectors are described in the Examples below. Conveniently, a combination expression vectors can be constructed by inserting nucleic acid sequences encoding the sense and antisense strands of siRNA targeted to a pro-angiogenic gene into the plasmid vectors in FIGS. 1A-1C. It is understood that the combination expression vector is both an "RNAi compound" and an "anti-angiogenic compound."

Figure 2:
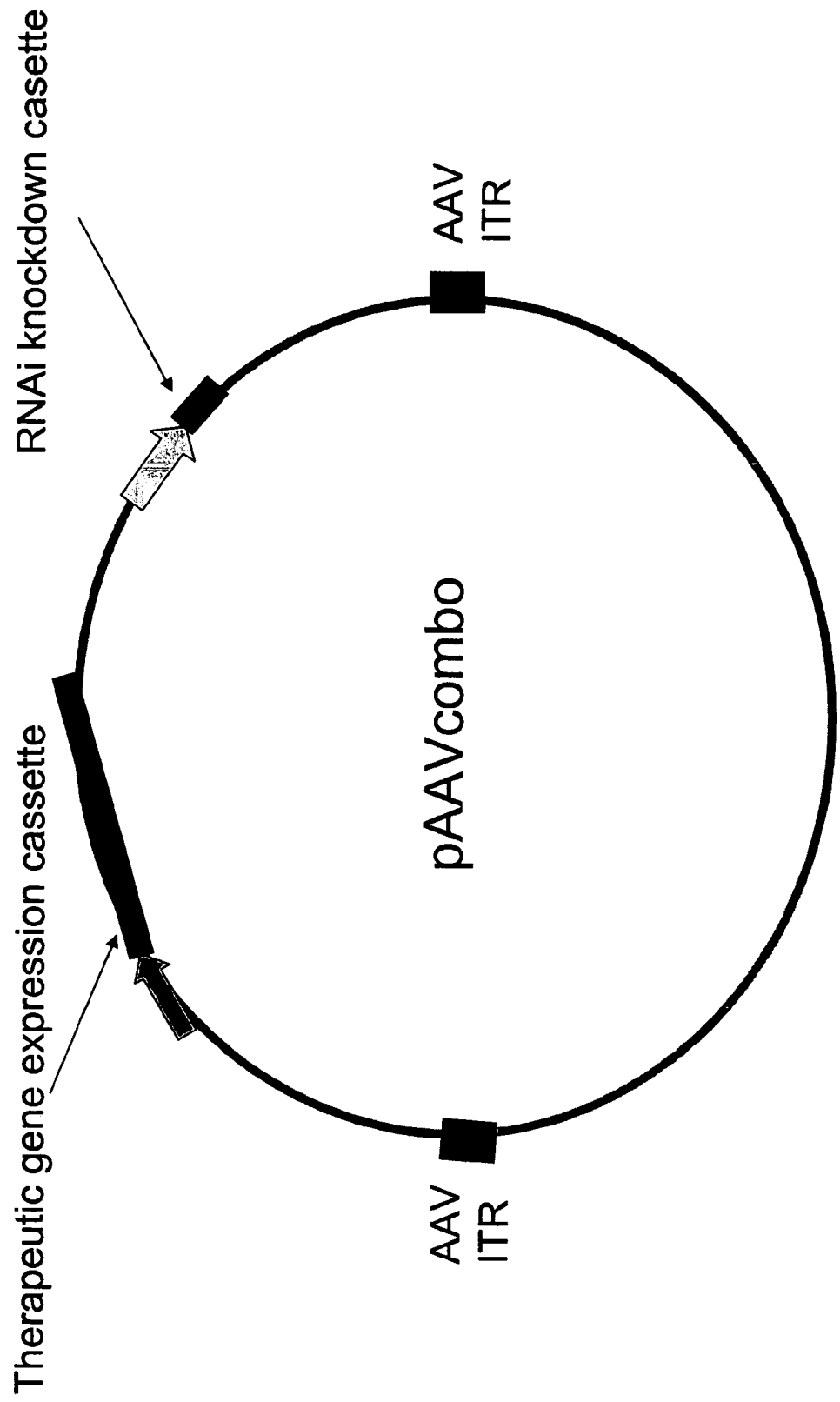
FIG. 2 is a schematic of a combination expression vector of the invention called "pAAVcombo." The two adeno-associated viral inverted terminal repeats are shown as "AAV ITR." Block arrows indicate promoters for expressing the genes comprising the downstream cassettes. The "therapeutic knockdown cassette" indicates the nucleic acid sequences for encoding the one or more genes to be expressed. The "RNAi knockdown cassette" indicates the nucleic acid sequences encoding the sense and antisense strands of the one or more dsRNA molecules to be expressed.

Another exemplary combination expression vector, called pAAVcombo, is shown in FIG. 2. The pAAVcombo vector comprises nucleic acid sequences for expressing one or more cellular factor genes (for example, one or more anti-angiogenic genes) and nucleic acid sequences for expressing one or more dsRNA for reducing expression of other cellular factor genes. As discussed above, any suitable promoter sequences can be used to construct combination expression vectors. The plasmid pAAVcombo also comprises inverted terminal repeats (ITRs) from AAV, which indicates that the vector can be used to produce a recombinant AAV vector of the invention. Similar combination expression vectors can be constructed which comprise components suitable for producing recombinant lentiviral vectors, adenoviral vectors, and the like, as is within the skill in the art.

The ability of RNAi compounds and anti-angiogenic compounds to cause, respectively, a reduction in pro-angiogenic gene expression and an increase in the level of anti-angiogenic factors in target cells can be evaluated in cell culture systems, using standard techniques for measuring the levels of RNA or protein in cells. For example, the levels of pro-angiogenic factor mRNA in a target cell can be measured by Northern blot or dot blotting techniques, or by quantitative RT-PCR. The level of pro-angiogenic and anti-angiogenic factors in the cultured cells can be measured by techniques such as ELISA or Western blot. Suitable cell culture systems include mouse NIH 3T3 cells, human retinal pigment epithelial cells, HeLa cells and human embryonic kidney (HEK) 293 cells.

For example, 50% confluent 293 human kidney cells can be incubated with culture medium containing an RNAi compound and anti-angiogenic compound for 48 hours, followed by ELISA or mRNA quantification of the appropriate pro- and anti-angiogenic factor mRNA or protein. Cells incubated with dsRNA which is not homologous to the target sequence and a non-specific protein can be used as controls.

For example, cells which naturally express (or which are induced to express) a pro-angiogenic factor are grown to confluence in 96-well microtiter plates. An RNAi compound and an anti-angiogenic compound can be administered to one group of cells. An expression vector expressing a non-specific siRNA (or no siRNA) and a non-specific protein can be administered to a second group of cells as a control. The cells are washed and directly fixed to the microtiter plate wells with 1 to 2% paraformaldehyde. Nonspecific binding sites on the microtiter plate are blocked with 2% bovine serum albumin. The cells are then incubated with monoclonal antibodies specific for a given pro-angiogenic and anti-angiogenic factor, each of which can be labeled with a different detection agent.

For example, bound antibodies for pro-angiogenic factors can be derived from mice, and can be detected by incubation with a 1:1000 dilution of biotinylated goat anti-mouse IgG (Bethesda Research Laboratories, Gaithersberg, Md.) for 1 hour at 37° C. and with a 1:1000 dilution of streptavidin conjugated to beta-galactosidase (Bethesda Research Laboratories) for 1 hour at 37° C. The amount of beta-galactosidase bound to the monoclonal antibodies is determined, for example, by developing the microtiter plate in a solution of 3.3 mM chlorophenolred-beta-D-galactopyranoside, 50 mM sodium phosphate, 1.5 mM $MgCl_2$; pH 7.2 for 2 to 15 minutes at 37° C., and measuring the concentration of bound antibodies at 575 nm in an ELISA microtiter plate reader. Bound antibodies for anti-angiogenic factors can be derived from rabbits, and can be detected with fluorescein-labeled goat anti-rabbit IgG.

The ability of RNAi compounds and anti-angiogenic compounds to cause, respectively, a reduction in pro-angiogenic gene expression and an increase in the level of anti-angiogenic factors in target cells can also be evaluated in vitro by measuring tube formation by bovine retinal endothelial cells (BRECs), using techniques within the skill in the art. An inhibition of tube formation indicates a reduction of pro-angiogenic gene expression and an increase in the level of anti-angiogenic factor in target cells.

A suitable BREC tube formation assay comprises culturing BRECs on fibronectin-coated dishes containing Dulbecco's modified Eagle's medium (DMEM) with 5.5 mM glucose, 10% platelet-derived horse serum (PDHS; Wheaton, Pipersville, Pa.), 50 mg/mL heparin, and 50 U/mL endothelial cell growth factor (Roche Molecular Biochemicals). BRECs suitable for use in the tube-formation assay exhibit endothelial homogeneity by immunoreactivity for factor VIII antigen, and remain morphologically unchanged under these conditions as confirmed by light microscopy.

The tube formation assay can be performed as described in King G L et al., *J. Clin. Invest.* 75:1028-1036 (1985) and Otani A et al., *Circ. Res.* 82: 619-628 (1998), the entire disclosures of which are herein incorporated by reference. Briefly, an 8:1:1 (400 microliter) mixture of Vitrogen 100 (Celtrix, Palo Alto, Calif.), 0.2 N NaOH and 200 mM HEPES in 10×RPMI medium (Gibco BRL, Gaithersburg, Md.), containing 5 microgram/mL fibronectin and 5 microgram/mL laminin, is added to 24-well plates. After polymerization of the gels, $1.0 \times 10^5$ of the cultured BRECs are seeded in the wells and incubated for 24 hours at 37° C. with DMEM containing 20% PDHS. The cell number is chosen to optimize the shape and tube length, as is known in the art (see King G L et al., 1985, supra and Otani A et al., 1998, supra). The medium is then removed, and additional collagen gel is introduced onto the cell layer. Before making the collagen gel, points can be randomly marked in the center area of the bottom of each well, in order to measure the density per surface area of any tubelike structures formed by the BRECs. Hypoxia-conditioned medium is then added to the wells to induce tube formation. An RNAi compound and an anti-angiogenic compound are then introduced into the BRECs of certain wells by any suitable procedure. Wells are treated with no RNAi compound and no anti-angiogenic compounds can be used as negative controls, and wells treated with non-specific dsRNA and non-specific protein can be used as positive controls. Inhibition of tube formation in the wells treated with RNAi compounds and anti-angiogenic compounds, as compared to control wells, indicates that expression of the pro-angiogenic gene has been has been inhibited and that the level of anti-angiogenic factor inside the cells has increased.

The effect of a treating a target cell with RNAi compounds and anti-angiogenic compounds can also be evaluated with animal models of neovascularization. Suitable animal models include mouse models of retinopathy of prematurity ("ROP") or choroidal neovascularization ("CNV") or primate models of CNV. For example, areas of neovascularization in an ROP or CNV mouse can be measured before and after treatment of target cells according to the present methods. A reduction in the areas of neovascularization in these models upon administration of the RNAi compounds and anti-angiogenic compounds indicates that expression of the pro-angiogenic gene has been reduced, and the level of anti-angiogenic factor inside the target cells has been increased.

Treatment of the target cells to reduce expression of at least one pro-angiogenic gene and to increase the level of at least one anti-angiogenic factor inhibits angiogenesis in a subject. Inhibition of angiogenesis in a subject can be evaluated by directly measuring the progress of pathogenic or nonpathogenic angiogenesis; for example, by observing the size of a neovascularized area before and after treatment of the target cells. An inhibition of angiogenesis is indicated if the size of the neovascularized area stays the same or is reduced. Techniques for observing and measuring the size of neovascularized areas in a subject are within the skill in the art; for example, areas of choroid neovascularization can be observed by ophthalmoscopy.

Inhibition of angiogenesis in a subject can also be inferred through observing a change or reversal in a pathogenic condition associated with the angiogenesis. For example, in AMD, a slowing, halting or reversal of vision loss indicates an inhibition of angiogenesis in the choroid. For tumors, a slowing, halting or reversal of tumor growth, or a slowing or halting of tumor metastasis, indicates an inhibition of angiogenesis at or near the tumor site. The size of a tumor can be ascertained by direct visual observation or by diagnostic imaging methods such as X-ray, magnetic resonance imaging, ultrasound, and scintigraphy. Diagnostic imaging methods used to ascertain size of a tumor can be employed with or without contrast agents, as is known in the art. The size of a tissue mass can also be ascertained by physical means, such as palpation of the tissue mass or measurement of the tissue mass with a measuring instrument such as a caliper. Inhibition of non-pathogenic angiogenesis in a subject can be inferred from, for example, fat loss or a reduction in cholesterol levels upon treatment of the target cells.

One skilled in the art can readily determine an effective amount of an RNAi compound or anti-angiogenic compound to be administered to a given subject, by taking into account factors such as the size and weight of the subject; the extent of the neovascularization or disease penetration; the age, health and sex of the subject; the route of administration; and whether the administration is regional or systemic.

Where the RNAi compound comprises an isolated dsRNA, an effective amount to be administered to a subject can comprise an amount which provides an intercellular concentration of the dsRNA at or near the neovascularization site of from about 1 nanomolar (mM) to about 100 nM, preferably from about 2 nM to about 50 nM, more preferably from about 2.5 nM to about 10 nM. Where the RNAi compound comprises an expression vector, an effective amount to be administered to a subject can comprise about 10 to about 1000 nanograms (ng), preferably about 20 to about 500 ng, particularly preferably about 50 to about 100 ng of the expression vector.

It is contemplated that greater or lesser amounts of RNAi compounds can be administered.

Where the anti-angiogenic compound comprises an isolated anti-angiogenic factor, an effective amount to be administered to a subject can comprise about 10 to about 3000 µg compound/kg of body weight. Preferably, the effective amount comprises about 50 to about 2000 µg compound/kg of body weight, more preferably about 100 to about 1000 µg compound/kg of body weight, particularly preferably about 150 to about 750 µg compound/kg of body weight, and is most preferably between about 200-500 µg compound/kg of body weight. Where the anti-angiogenic compound comprises an expression vector expressing the anti-angiogenic factor, an effective amount for administration to a subject can comprise about 10 to about 1000 nanograms (ng), preferably about 20 to about 500 ng, particularly preferably about 50 to about 100 ng.

It is contemplated that greater or lesser amounts of anti-angiogenic compounds can be administered.

The RNAi compounds and anti-angiogenic compounds can be administered in a single dose or in multiple doses. Where the administration is by infusion, the infusion can be a single sustained dose or can be delivered by multiple infusions. Injection directly into the tissue is at or near the site of neovascularization preferred. Multiple injections into the tissue at or near the site of neovascularization are particularly preferred.

One skilled in the art can also readily determine an appropriate dosage regimen for administering the RNAi compounds and anti-angiogenic compounds to a given subject. For example, the administration can be a single injection or deposition at or near the neovascularization site. Alternatively, the administration can be performed multiple times, for example daily or weekly. Preferably, the administration is once weekly for a period of from about three to about twenty-eight weeks, more preferably from about seven to about twenty weeks. In a particularly preferred dosage regimen, administration is by injection at or near the site of neovascularization (e.g., intravitreally) once every twelve weeks for an indefinite period of time. It is understood that periodic administrations for an indefinite length of time may be necessary for subjects suffering from a chronic neovascularization disease, such as wet AMD or diabetic retinopathy.

Where a dosage regimen comprises multiple administrations, it is understood that the effective amounts of RNAi compounds and anti-angiogenic compounds which are administered to the subject can comprise the total amount administered over the entire dosage regimen.

The present method can be used to inhibit angiogenesis which is non-pathogenic; i.e., angiogenesis which results from normal processes in the subject. Examples of non-pathogenic angiogenesis include endometrial neovascularization, and processes involved in the production of fatty tissues or cholesterol. Thus, the invention provides a method for inhibiting non-pathogenic angiogenesis; e.g., for controlling weight or promoting fat loss, for reducing cholesterol levels, or as an abortifacient.

The present methods can also inhibit angiogenesis which is associated with an angiogenic disease; i.e., a disease in which pathogenicity is associated with inappropriate or uncontrolled angiogenesis. For example, most cancerous solid tumors generate an adequate blood supply for themselves by inducing angiogenesis in and around the tumor site. This tumor-induced angiogenesis is often required for tumor growth, and also allows metastatic cells to enter the bloodstream. Other angiogenic diseases that can be treated with the present method include AMD, diabetic retinopathy, psoriasis, rheumatoid arthritis and other inflammatory diseases.

Preferably, the growth or metastasis of solid tumors associated with cancers is inhibited; for example breast cancer, lung cancer, head and neck cancer, brain cancer, abdominal cancer, colon cancer, colorectal cancer, esophagus cancer, gastrointestinal cancer, glioma, liver cancer, tongue cancer, neuroblastoma, osteosarcoma, ovarian cancer, pancreatic cancer, prostate cancer, retinoblastoma, Wilm's tumor, multiple myeloma; skin cancer (e.g., melanoma), lymphomas and blood cancer. More preferably, choroidal neovascularization in age-related macular degeneration or diabetic retinopathy is inhibited.

Another group of genes which cause a cell to exhibit a particular phenotype are the anti- and pro-apoptotic genes, examples of which are listed in Tables 10 and 11, respectively. The nucleic acid sequences encoding the corresponding anti- and pro-apoptotic factors and the amino acid sequences of these factors are provided in the sequence listing as indicated in Tables 10 and 11. Tables 10 and 11 and the sequences referred to therein are adapted from information provided on the website maintained by InvivoGen (San Diego, Calif. 92121).

TABLE 10

Anti-apoptotic Genes

| Reference[4] | Anti-apoptotic Gene | Organism | SEQ ID NO: nucleotide | SEQ ID NO: protein |
|---|---|---|---|---|
| Chen M C et al. (2000), J Biol Chem 2000 Sep 18 | Bcl-2 (B-cell leukemia/lymphoma-2) | Homo sapiens Mus musculus | 1704 1706 | 1705 1707 |
| Gauthier E R et al. (1996), Cancer Res 56: 1451-1456 | BclX$_L$ (long isoform) | Homo sapiens | 1708 | 1709 |

[4]All documents listed in Table 10 are herein incorporated by reference in their entirety.

TABLE 11

Pro-apoptotic Genes

| Reference[3] | Pro-apoptotic Genes | Organism | SEQ ID NO: nucleotide | SEQ ID NO: protein |
|---|---|---|---|---|
| Jan M S et al. (1999) Biochem Biophys Res Commun 264: 724-9 | Bad (Bcl2-antagonist of cell death) | Homo sapiens Mus musculus | 1710 1712 | 1711 1713 |
| Pataer A et al. (2000) Cancer Res 60: 788-92 | Bak (a Bcl2 homolog) | Homo sapiens | 1714 | 1715 |
| Kobayashi T et al. (1998) Oncogene 16: 1587-1591 | Bax | Homo sapiens Mus musculus | 1716 1718 | 1717 1719 |
| Dole M G et al. (1996), Cancer Res 56: 5734-5740 | BclX$_S$ (short isoform) | Homo sapiens | 1720 | 1721 |
| Elangovan B et al. (1997), J Biol Chem 272: 24494-24498 | Bik (Bcl2 interacting killer) | Homo sapiens | 1722 | 1723 |
| Yamabe K et al. (1999), Gene Ther 6: 1952-9 | Casp-3 (Caspase-3) | Homo sapiens | 1724 | 1725 |

[3]All documents listed in Table 11 are herein incorporated by reference in their entirety.

Thus, in another embodiment, the invention provides a method of inducing apoptosis in a target cell, for example a cancer cell, by reducing expression of at least one anti-apoptotic gene and increasing the level of at least one pro-apoptotic factor in a target cell. Inducing apoptosis in cancer cells by the present method can inhibit tumor growth or metastasis in a subject. Thus, suitable target cells include tumor or cancer cells of the cancers listed above.

Reduction in expression of an anti-apoptotic gene in a target cell is achieved by treating the cell with one or more isolated dsRNA (e.g., one or more isolated siRNA) that induces RNAi of at least one anti-apoptotic gene. For example, the expression of Bcl-2 gene, or a Bcl-2 gene and a Bcl-$_{XL}$ gene, can be reduced in a target cell by RNAi. A dsRNA which induces RNAi of an anti-apoptotic gene can also be expressed from an expression vector inside a target cell.

As above, compounds comprising isolated dsRNA or expression vectors expressing dsRNA are referred to as "RNAi compounds." RNAi compounds which can induce RNAi of the anti-apoptotic genes can be produced by techniques within the skill in the art as described above, using the nucleic acid sequences from the figures referred to in Table 10. For example, target sequences for producing siRNA targeted to anti-apoptotic genes can be selected as outlined in Tuschl T et al., "The siRNA User Guide," supra, and used to construct an siRNA.

Target cells are also treated to increase the level of at least one pro-apoptotic factor, for example by inducing the cell to up-regulate one or more pro-apoptotic genes, or by introducing one or more isolated pro-apoptotic factors or an expression vector which encodes one or more pro-apoptotic factor into the target cell. Expression vectors encoding pro-apoptotic factors can be constructed using the nucleic acid sequences from the figures referenced in Table 11, using techniques within the skill in the art as described above. Any compound which increases the level of a pro-apoptotic factor in a target cell is a "pro-apoptotic compound."

As above, a target cell is "treated" a with an RNAi compound or pro-apoptotic compound by any technique suitable to introduce those compounds into a target cell, including direct administration to the cells, administration in conjunction with a nucleic acid delivery reagent, or transfection of the cell. Techniques for obtaining and introducing RNAi compounds or pro-apoptotic compounds into target cells are as described above for the RNAi compounds and anti-angiogenic compounds used to inhibit angiogenesis in a subject.

In a preferred embodiment, target cells in a subject are treated with a combination expression vector, which is a single expression vector comprising nucleic acid sequences encoding at least one siRNA targeted to one or more anti-apoptotic genes, and nucleic acid sequences that encode at least one pro-apoptotic gene. It is understood that the combination expression vector is both an RNAi compound and a pro-apoptotic compound.

The effective amount of an RNAi compound or pro-apoptotic compound for administration to a subject is determined by the particular circumstances of the individual subject, including the subject's size, weight, age and sex, the nature and stage of the disease being treated, the aggressiveness of the disease, the route of administration, and whether the administration is regional or systemic. One of ordinary skill in the art is capable of evaluating these factors and choosing an appropriate amount of the present compounds. Effective amounts of the RNAi compound for inducing RNAi of anti-apoptotic genes, and effective amounts of pro-apoptotic compounds, are as described above for the RNAi compounds and anti-angiogenic compounds used to inhibit angiogenesis in a subject.

The ability of RNAi compounds and pro-apoptotic compounds to cause, respectively, a reduction in anti-apoptotic gene expression and an increase in the level of pro-apoptotic factors in target cells can be evaluated in cell culture systems. For example, cultured cells can be analyzed daily for survival and induction of the apoptotic response over a period of 10 days. Cell number and viability is determined by trypan blue exclusion, and cell cycle distribution and the presence of sub-diploid cells in the treatment groups is determined by flow cytometry analysis. For the flow cytometric analysis, cells are washed twice in 1% phosphate-buffered saline (PBS) containing 1% FBS, and the washed cells are fixed in 80% cold ethanol for 60 minutes, pelleted and resuspended in PBS/1% FBS containing 50 µg/ml of propidium iodide and 1 mg/ml of RNAse. After a 30 minute incubation at 37° C., the cells are analyzed with a Coulter Epic Elite flow cytometer. DNA can be isolated from the cells and electrophoresed on 1.8% agarose gels to demonstrate the appearance of "ladders," which result from the endonucleolytic cleavage of DNA characteristic of apoptosing cells.

Treatment of the target cells in a subject to reduce expression of at least one anti-apoptotic gene and to increase the level of at least one pro-apoptotic factor inhibits tumor growth in a subject. Inhibition of tumor growth can be inferred if the size of a tumor remains constant or decreases over time. The size of a tumor can be ascertained by direct visual observation or by diagnostic imaging methods such as X-ray, magnetic resonance imaging, ultrasound, and scintigraphy. Diagnostic imaging methods used to ascertain size of a tumor can be employed with or without contrast agents, as is known in the art. The size of a tumor can also be ascertained by physical means, such as palpation of the tumor or measurement of the tumor with a measuring instrument such as a caliper.

The RNAi compounds and anti-angiogenic or pro-apoptotic compounds are preferably formulated as pharmaceutical compositions prior to administering to a subject, according to techniques known in the art. Pharmaceutical compositions of the present invention are characterized as being at least sterile and pyrogen-free. As used herein, "pharmaceutical formulations" include formulations for human and veterinary use. Methods for preparing pharmaceutical compositions of the invention are within the skill in the art, for example as described in *Remington's Pharmaceutical Science*, 17th ed., Mack Publishing Company, Easton, Pa. (1985), the entire disclosure of which is herein incorporated by reference.

The present pharmaceutical formulations comprise, for example, RNAi compounds and anti-angiogenic or pro-apoptotic compounds (e.g., 0.1 to 90% by weight), or a physiologically acceptable salt thereof, mixed with a physiologically acceptable carrier medium. Preferred physiologically acceptable carrier media are water, buffered water, saline solutions (e.g., normal saline or balanced saline solutions such as Hank's or Earle's balanced salt solutions), 0.4% saline, 0.3% glycine, hyaluronic acid and the like.

Pharmaceutical compositions of the invention can also comprise conventional pharmaceutical excipients and/or additives. Suitable pharmaceutical excipients include stabilizers, antioxidants, osmolality adjusting agents, buffers, and pH adjusting agents. Suitable additives include physiologically biocompatible buffers (e.g., tromethamine hydrochloride), additions of chelants (such as, for example, DTPA or DTPA-bisamide) or calcium chelate complexes (as for example calcium DTPA, CaNaDTPA-bisamide), or, optionally, additions of calcium or sodium salts (for example, calcium chloride, calcium ascorbate, calcium gluconate or calcium lactate). Pharmaceutical compositions of the invention can be packaged for use in liquid form, or can be lyophilized.

For topical administration to the eye, conventional intraocular delivery reagents can be used. For example, pharmaceutical compositions of the invention for topical intraocular delivery can comprise saline solutions as described above, corneal penetration enhancers, insoluble particles, petrolatum or other gel-based ointments, polymers which undergo a viscosity increase upon instillation in the eye, or mucoadhesive polymers. Preferably, the intraocular delivery reagent increases corneal penetration, or prolongs preocular retention of the RNAi compounds, anti-angiogenic or pro-apoptotic compounds through viscosity effects or by establishing physicochemical interactions with the mucin layer covering the corneal epithelium.

Suitable insoluble particles for topical intraocular delivery include the calcium phosphate particles described in U.S. Pat. No. 6,355,271 of Bell et al., the entire disclosure of which is herein incorporated by reference. Suitable polymers which undergo a viscosity increase upon instillation in the eye include polyethylenepolyoxypropylene block copolymers such as poloxamer 407 (e.g., at a concentration of 25%), cellulose acetophthalate (e.g., at a concentration of 30%), or a low-acetyl gellan gum such as Gelrite® (available from CP Kelco, Wilmington, Del.). Suitable mucoadhesive polymers include hydrocolloids with multiple hydrophilic functional groups such as carboxyl, hydroxyl, amide and/or sulfate groups; for example, hydroxypropylcellulose, polyacrylic acid, high-molecular weight polyethylene glycols (e.g., >200,000 number average molecular weight), dextrans, hyaluronic acid, polygalacturonic acid, and xylocan. Suitable corneal penetration enhancers include cyclodextrins, benzalkonium chloride, polyoxyethylene glycol lauryl ether (e.g., Brij® 35), polyoxyethylene glycol stearyl ether (e.g., Brij® 78), polyoxyethylene glycol oleyl ether (e.g., Brij® 98), ethylene diamine tetraacetic acid (EDTA), digitonin, sodium taurocholate, saponins and polyoxyethylated castor oil such as Cremaphor EL.

For solid compositions, conventional nontoxic solid carriers can be used; for example, pharmaceutical grades of mannitol, lactose, starch, magnesium stearate, sodium saccharin, talcum, cellulose, glucose, sucrose, magnesium carbonate, and the like.

For example, a solid pharmaceutical composition for oral administration can comprise any of the carriers and excipients listed above and 10-95%, preferably 25%-75%, of one or more RNAi compounds, anti-angiogenic or pro-apoptotic compounds. A pharmaceutical composition for aerosol (inhalational) administration can comprise 0.01-20% by weight, preferably 1%-10% by weight, of one or more siRNA of the invention encapsulated in a liposome as described above, and propellant. A carrier can also be included as desired; e.g., lecithin for intranasal delivery.

The invention will now be illustrated by the following non-limiting examples.

Example 1

Expression of PEDF and siRNA Targeted to VEGF in Human Cells

Plasmids expressing human PEDF and either hVEGF#5 or hVEGF#2 siRNA (which target human VEGF mRNA) or negative control siRNA were constructed as follows.

Figure 3:
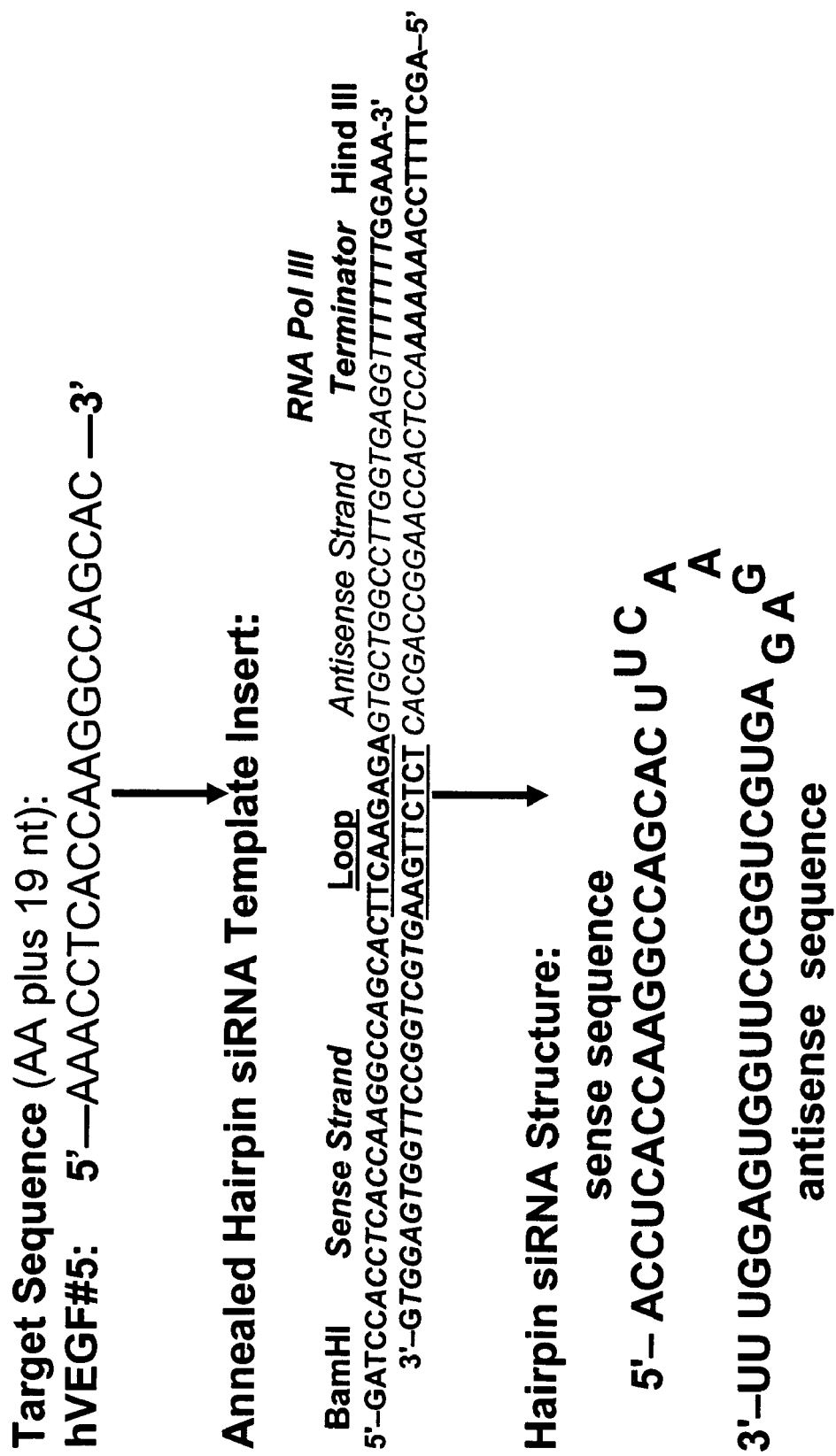
FIG. 3 is a schematic showing the HVEGF#5 siRNA target sequence, the double-stranded DNA insert used to construct plasmids which express a HVEGF#5 hairpin siRNA, and the structure of the hairpin HVEGF#5 siRNA transcribed from the double-stranded DNA insert.

Complementary oligonucleotides for expressing hVEGF#5 or hVEGF#2 siRNA were synthesized, annealed, and ligated into pSilencer 2.0-U6 siRNA Expression Vector (Ambion #7209). An oligonucleotide sequence for expressing a negative control hairpin siRNA was also synthesized, annealed and ligated into the pSilencer vector. The negative control siRNA consisted of a random target sequence. These oligonucleotides formed a hairpin structure when expressed. (See FIG. 3 for a schematic of the hVEGF#5 target sequence, the annealed DNA insert encoding hVEGF#5 hairpin siRNA, and the hVEGF#5 hairpin siRNA.).

The complementary oligonucleotides used to form the double-stranded insert encoding the hVEGF#5 siRNA hairpin were:

```
hVEGF#5-a
                                          (SEQ ID NO.1728)
GATCCACCTCACCAAGGCCAGCACTTCAAGAGAGTGCTGGCCTTGGTGAG
GTTTTTTTGGAAA hVEGF#5-b
                                          (SEQ ID NO.1729)
AGCTTTTCCAAAAAAACCTCACCAAGGCCAGCACTCTCTTGAAGTGCTGG
CCTTGGTGAGGTG

The complementary oligonucleotides used to form
the double-stranded insert encoding the hVEGF#2
siRNA hairpin were:

hVEGF#2-a
                                          (SEQ ID NO.1730)
GATCCGTTCATGGATGTCTATCAGTTCAAGAGACTGATAGACATCCATGA
ACTTTTTTGGAAA hVEGF#2-b
                                          (SEQ ID NO.1731)
AGCTTTTCCAAAAAAGTTCATGGATGTCTATCAGTCTCTTGAACTGATAG
ACATCCATGAACG
```

The DNA fragments from the plasmids which produce the siRNA hairpin structures and the pU6 promoter were removed from the pSilencer vector by digestion with restriction enzyme PvuII. The PvuII fragments were inserted separately into the pCMS-EGFP vector (BD #6101-1), in place of the EGFP/PvuII fragment in that vector. The resulting plasmids were named pCMS-pU6-(siRNA)

A human PEDF cDNA fragment (SEQ ID NO. 1727) was then inserted into the MluI and SalI sites in the multiple cloning site on each plasmid pCMS-pU6-(siRNA), under the control of the pCMV promoter. The resulting plasmids were called pCMS-PEDF-pU6-(siRNA), and contained a human PEDF cDNA open reading frame under a pCMV promoter, and a nucleotide sequence encoding an siRNA hairpin targeting human VEGF under a pU6 promoter. In all, three plasmids were made: pCMS-PEDF-pU6-HVEGF#5; pCMS-PEDF-pU6-hVEGF#2; and pCMS-PEDF-pU6-NC (expressing a negative control siRNA targeted to enhanced green fluorescent protein or "EGFP").

Human embryonic kidney (HEK) 293 cells were cultured overnight in 24 well plates at 37° C. with 5% $CO_2$. The next day, transfections with the pCMS-PEDF-pU6-(siRNA) plasmids in calcium phosphate ("CaPi") reagent were performed when cells were 70% confluent. The amount of plasmid used to transfect the cells was 0.5 µg, 1 µg, and 2 µg for each of pCMS-PEDF-pU6-HVEGF#5, pCMS-PEDF-pU6-hVEGF#2, and pCMS-PEDF-pU6-NC. Other controls included mock transfection of cells with CaPi transfection reagent lacking plasmid, 25 nM hVEGF#2 siRNA and plasmid pCMS-pU6-hVEGF#2 (which lacks the PEDF sequence).

Hypoxia was induced in the HEK 293 cells with desferrioxamine at a final concentration of 130 µM four hours after transfection. Twenty four and 48 hours post transfection, the supernatant was removed from all culture dish wells, and a human VEGF ELISA (R & D systems, Minneapolis, Minn.) and a human PEDF ELISA (Chemicon, Temecula, Calif.) were performed according to the manufacturer's instructions. ELISA results were read on an AD340 plate reader (Beckman Coulter), and are reported in FIG. 4.

Figure 4:
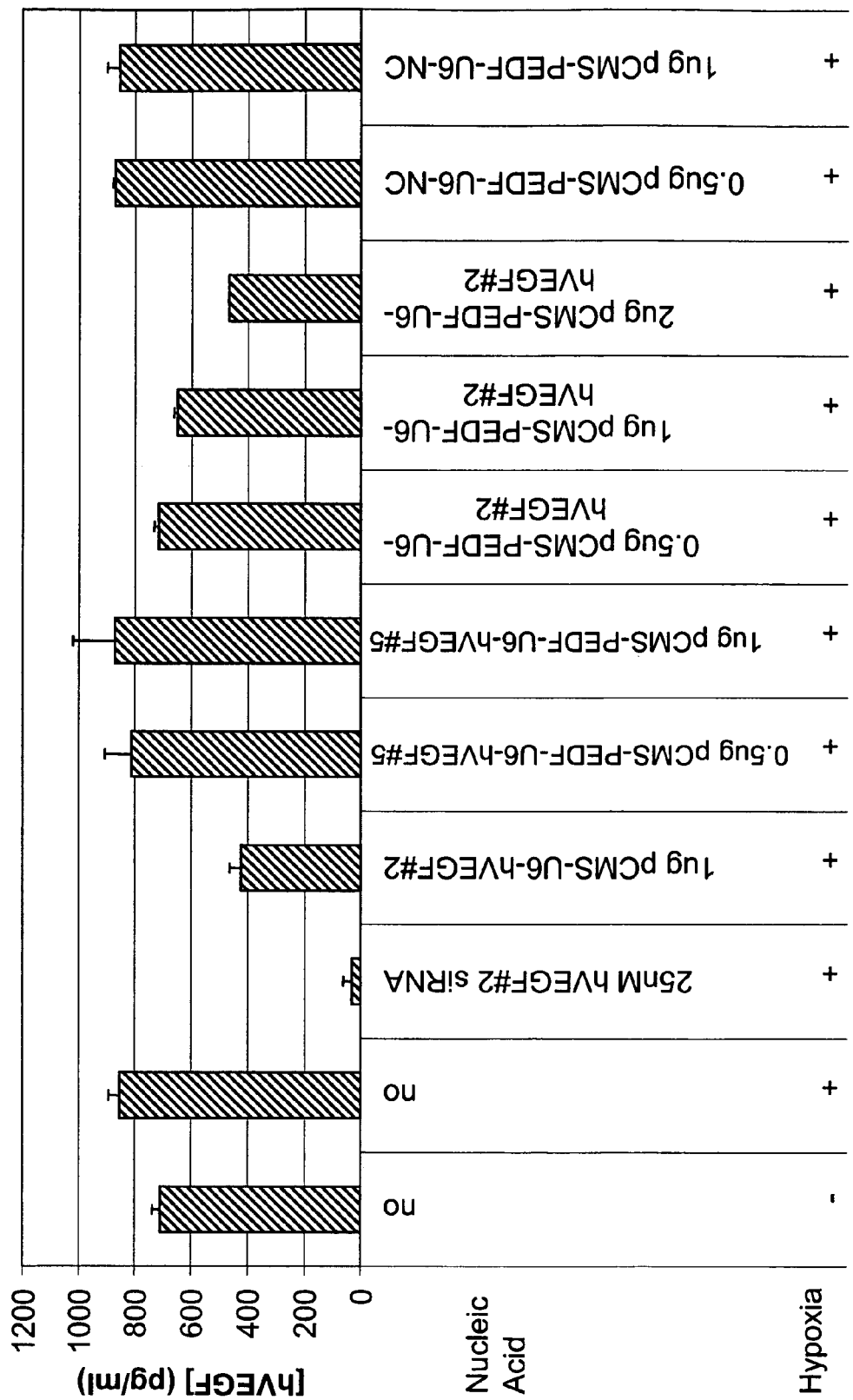
FIG. 4 is a histogram showing that plasmid pCMS-PEDF-pU6-hVEGF#2 suppressed hypoxia induced up-regulation of human VEGF in 293 cells in a dose dependent manner. The serial doses of plasmids pCMS-PEDF-pU6-HVEGF#5, pCMS-PEDF-pU6-hVEGF#2, and pCMS-PEDF-pU6-NC (0.5 µg, 1 µg, and 2 µg) or controls (hVEGF#2 siRNA, plasmid pCMS-pU6-hVEGF#2, or transfection reagent only) were transfected into 293 cells. VEGF levels were measured in cell supernatants by ELISA 48 hours after hypoxia induction.

As shown in FIG. 4, human VEGF was upregulated by the desferrioxamine-mediated induction of hypoxia. The hypoxia-induced increase of hVEGF protein level reduced significantly from cells transfected with plasmids pCMS-PEDF-pU6-hVEGF#2 in a dose-dependent manner. The positive controls hVEGF#2 siRNAs and plasmid pCMS-pU6-hVEGF#2 showed suppression of hVEGF expression in the HEK 293 cells, while transfections with negative control plasmid pCMS-PEDF-pU6-NC or mock transfection without plasmid had no effect on hVEGF levels. Plasmid pCMS-PEDF-pU6-HVEGF#5 showed moderate suppression of human VEGF expression in this experiment.

Figure 5:
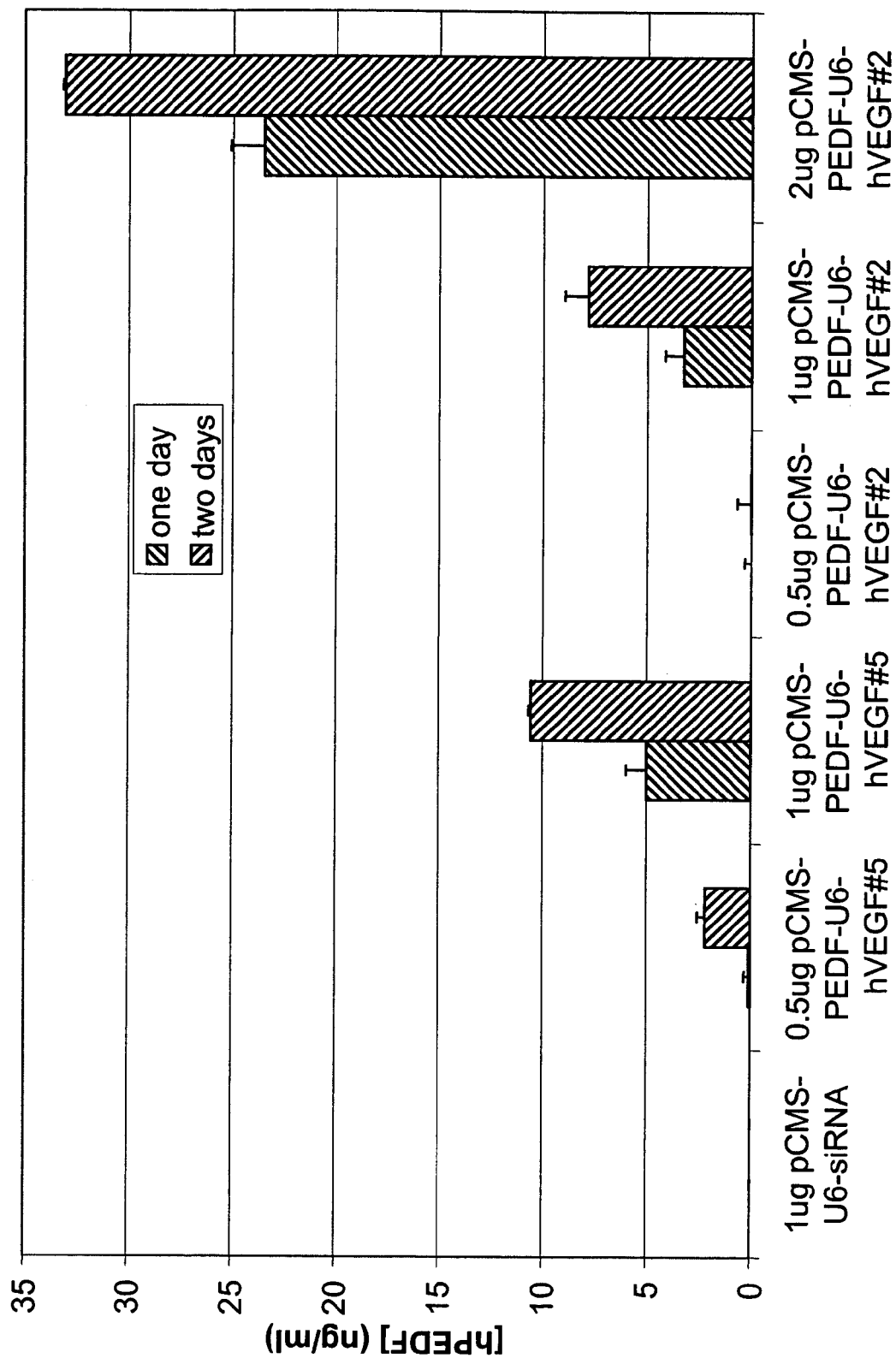
FIG. 5 is a histogram showing that plasmids pCMS-PEDF-pU6-HVEGF#5 and pCMS-PEDF-pU6-hVEGF#2 expressed human PEDF protein in HEK 293 cells in a dose and time dependent manner. The serial doses of plasmids pCMS-PEDF-pU6-HVEGF#5 and pCMS-PEDF-pU6-hVEGF#2 (0.5 µg, 1 g, and 2 µg) or controls (plasmid pCMS-pU6siRNAs) were transfected into HEK 293 cells. Human PEDF protein levels were measured in cell supernatants by ELISA 24 hours and 48 hours after hypoxia induction.

Plasmids pCMS-PEDF-pU6-siRNAs (HVEGF#5 and hVEGF#2 siRNAs) expressed human PEDF protein in HEK 293 cells in a dose and time dependent manner (see FIG. 5). No human PEDF was detected in supernatants from cells which were mock transfected or transfected with control plasmids.

Figure 6:
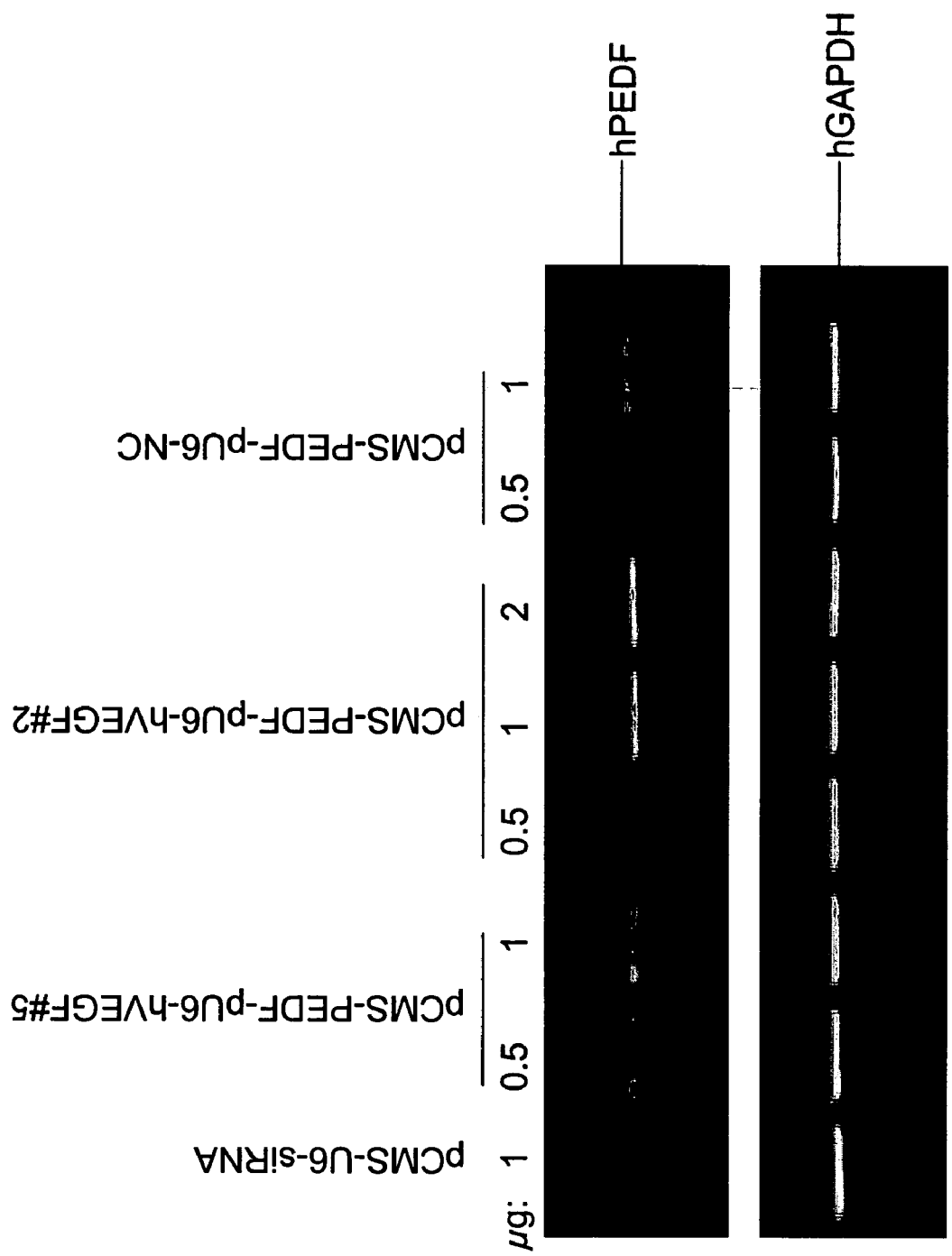
FIG. 6 is a histogram showing results of a cytotoxicity assay of HEK 293 cells transfected with siRNAs or plasmids as indicated. The cytotoxicity assay was performed with AlamarBlue by measuring cell proliferation 48 hours after transfection and hypoxia induction.

After the supernatants were removed from cells after transfection as described above, a cytotoxicity assay was performed as follows: Complete growth medium containing 10% AlamarBlue (Biosource, Camarillo, Calif.) was added to each well, and cells were incubated at 37° C. with 5% $CO_2$ for 3 hours. Cell proliferation was measured by detecting the color change of medium containing AlamarBlue which resulted from cell metabolic activity. Cytotoxicity assay results were read on an AD340 plate reader (Beckman Coulter), and are reported in FIG. 6. As shown in FIG. 6, desferrioxamine-mediated hypoxia caused slight cytotoxicity to HEK 293 cells. The transfection with functional plasmids showed no apparent cytotoxicity as compared with transfection of HEK cells with negative control plasmids or mock transfections.

After cytotoxicity assay, the growth medium in each well was completely removed. RNA extractions from the HEK 293 cells were performed by using the RNAqueous RNA isolation kit (Ambion, Austin, Tex.) according to the manufacturer's instructions. Human VEGF and PEDF mRNA levels of in HEK 293 cells were measured by reverse transcription-polymerase chain reaction (RT-PCR). Expression of human glyceraldehyde-3-phosphate dehydrogenase (GAPDH) mRNA was used as a control.

Figure 7:
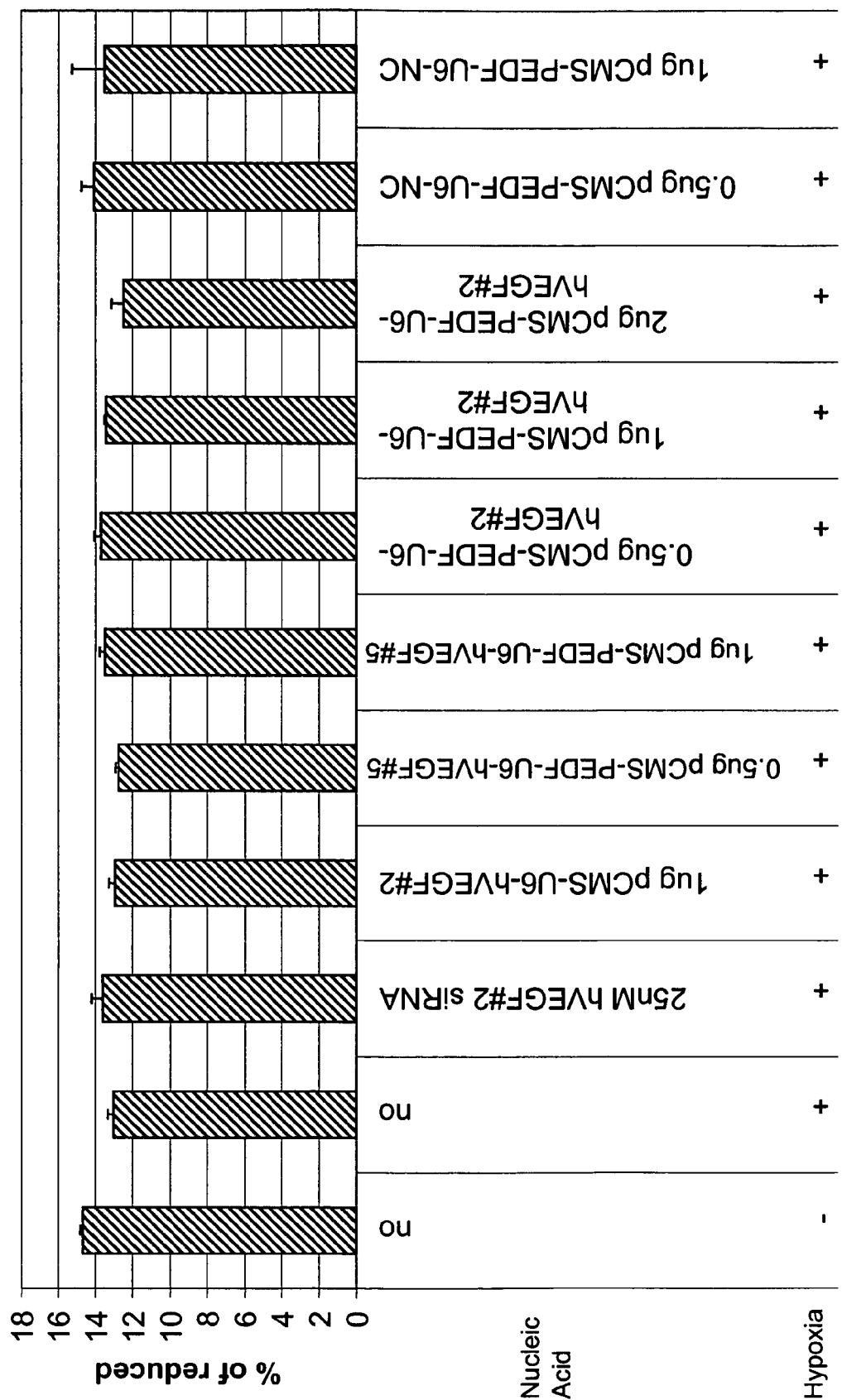
FIG. 7 is a photograph of an agarose gel showing that plasmids pCMS-PEDF-pU6-siRNAs expressed human PEDF in a dose dependent manner at the transcriptional level. RNAs from HEK 293 cells transfected with different doses of plasmids pCMS-PEDF-pU6-siRNAs (0.5 µg, 1 µg, and 2 µg) or negative control plasmid pCMS-pU6-siRNAs were extracted and subjected to RT-PCR for detection of human PEDF and control (human GAPDH) mRNA.

Hypoxia-induced upregulation of human VEGF in HEK 293 cells was suppressed significantly by plasmid pCMS-PEDF-pU6-hVEGF#2 in a dose-dependent manner at the transcriptional level, as measured by RT-PCR (see FIG. 7). The VEGF mRNA levels in HEK 293 cells transfected with the negative control siRNA or cells which were mock transfected were not affected. The cells transfected with the negative control plasmids showed very weak PEDF mRNA signals, which may have come from the endogenous PEDF gene. These results indicate that the expression of hVEGF#2 siRNA in HEK 293 cells suppressed VEGF mRNA expression, and that this suppression was correlated with VEGF suppression at the protein level.

Example 2

Expression of Angiostatin and siRNA Targeted to HIF-1 Alpha in Human Cells

Two complementary oligonucleotides were synthesized, annealed, and ligated into pSilencer 2.0-U6 siRNA Expression Vector (Ambion #7209) as in Example 1 above, to express either a hairpin siRNA hHIF1α#11 or a negative control siRNA targeted to EGFP. The complementary oligonucleotides used to form the double-stranded DNA insert encoding the HIF1-alpha siRNA hairpin were:

```
hHIF1-alpha#11-a
                                         (SEQ ID NO.1732)
GATCCAGTCGGACAGCCTCACCAATTCAAGAGATTGGTGAGGCTGTCCGA
CTTTTTTTGGAAA hHIF1-alpha#11-b
                                         (SEQ ID NO.1733)
AGCTTTTCCAAAAAAAGTCGGACAGCCTCACCAATCTCTTGAATTGGTGA
GGCTGTCCGACTG
```

The DNA fragments encoding the siRNA hairpin structures were excised from the pSilencer vector along with the pU6 promoter using PvuII, and inserted into the pCMS-EGFP vector (BD #6101-1) in place of the EGFP/PvuII fragment. The resulting plasmids were named pCMS-pU6-(siRNA). A human angiostatin cDNA fragment (the N-terminal fragment of human plasminogen up to residue 384; SEQ ID NO: 1726) was then inserted into the MluI and SalI sites in the multi-cloning site (MCS) of the pCMS-pU6-(siRNA) plasmids, under control of the pCMV promoter. The resulting plasmids were called pCMS-Angst-pU6-(siRNA), and contained an human angiostatin open reading frame under a pCMV promoter and an siRNA hairpin targeting human HIF1α or EGFP under a pU6 promoter. In all, two plasmids were made: pCMS-Angst-pU6-hHIF1-alpha#11 and pCMS-Angst-pU6-NC (expressing a negative control siRNA targeted to enhanced EGFP).

HEK 293 cells were grown and transfected with 0.5 μg, 1 μg, and 2 μg pCMS-Angio-pU6-hHIF1-alpha#11 as described in Example 1. The transfection controls used were plasmid pCMS-PEDF-pU6-NC from Example 1, plasmid pCMS-pU6-hHIF1-alpha#11 (which does not express angiostatin), hHIF1-alpha#11 siRNA, and mock transfection with CaPi transfection reagent but no plasmid. Measurement of HiF-1 alpha protein and mRNA levels and cytotoxicity assays were performed as in Example 1.

Figure 8:
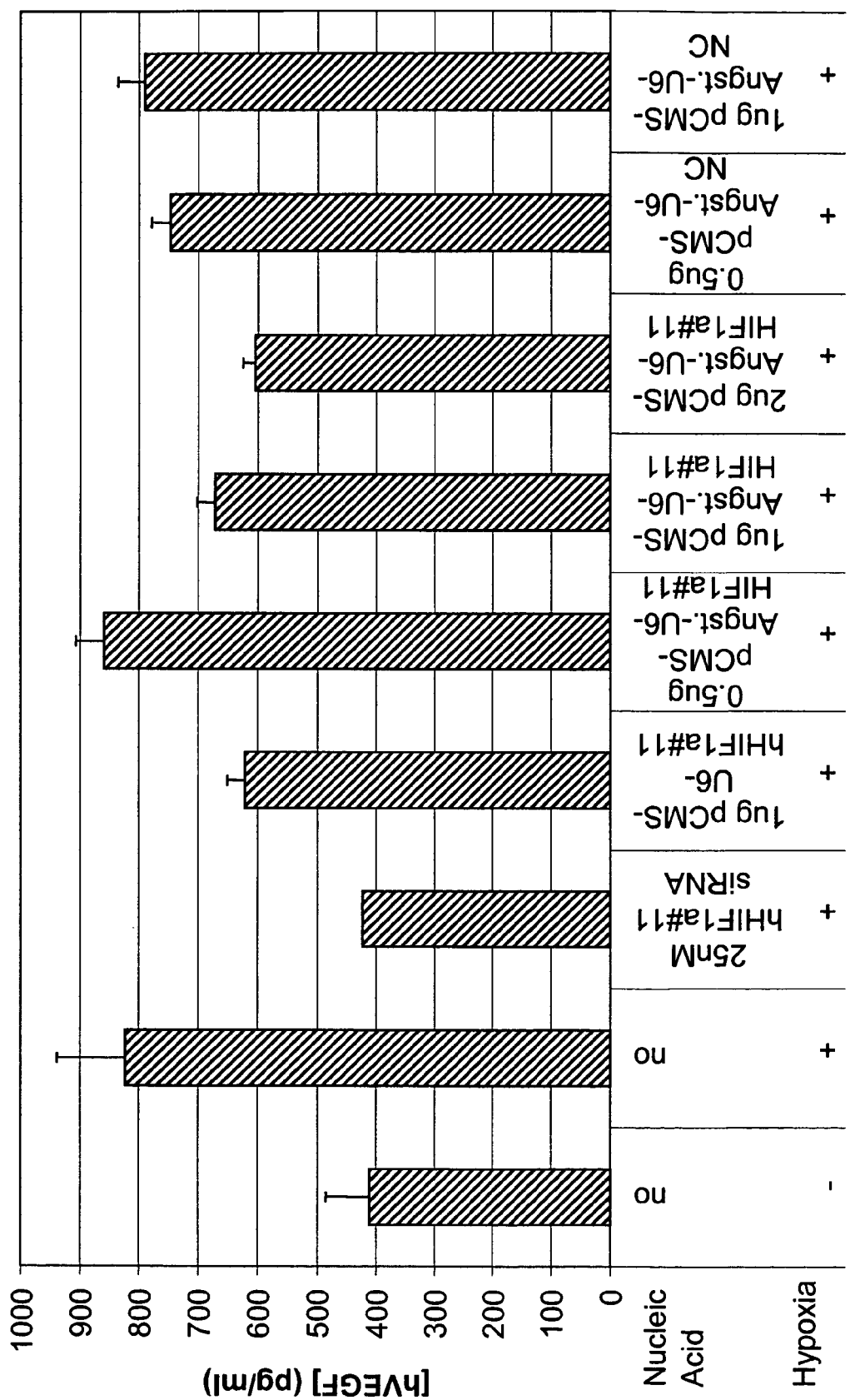
FIG. 8 is a histogram showing that plasmid pCMS-Angst-pU6-hHIF1α#11 suppressed hypoxia induced up-regulation of human VEGF in HEK 293 cells in a dose dependent manner. Serial doses of plasmids pCMS-Angst-pU6-hHIF1α#11 and negative control plasmid pCMS-Angst-pU6-NC (0.5 µg, 1 µg, and 2 µg each) or controls (hHIF1α#11 siRNA, plasmid pCMS-pU6-hHIF1α#11, or transfection reagent only) were transfected into HEK 293 cells. VEGF protein levels were measured in cell supernatants by ELISA at 48 hours after hypoxia induction.

As shown in FIG. 8, human VEGF was upregulated by the desferrioxamine-mediated induction of hypoxia. The hypoxia-induced increase of hVEGF protein level reduced significantly from cells transfected with plasmids pCMS-Angst-pU6-hHIF1α#11 in a dose-dependent manner. The positive controls hHIF1α·11 siRNAs and plasmid pCMS-pU6-hHIF1α#11 showed significant suppression of hVEGF expression while transfections with negative control plasmid pCMS-Angst-pU6-NC or mock transfection without plasmid had no effect on hVEGF levels.

Figure 9:
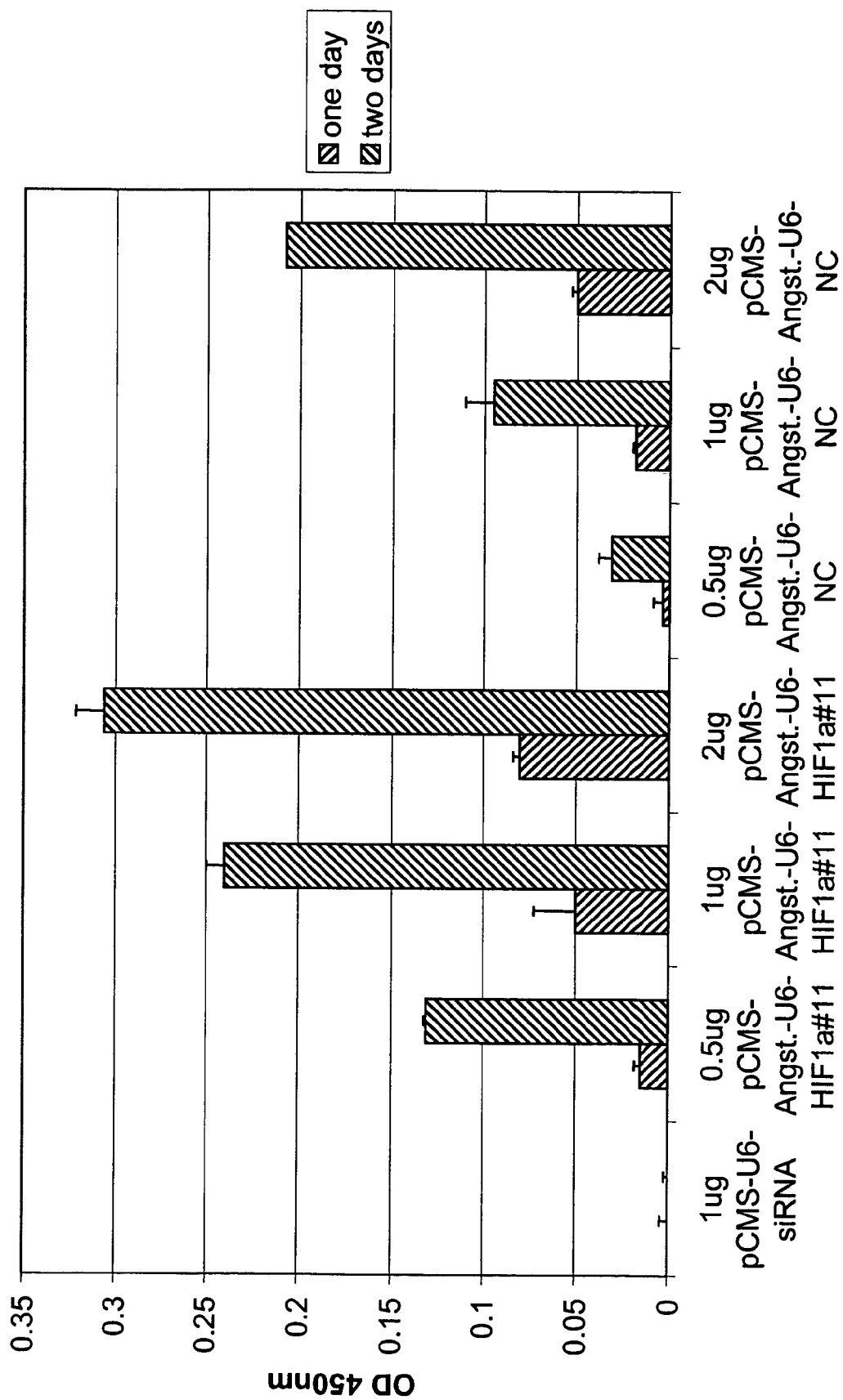
FIG. 9 is a histogram showing that plasmid pCMS-Angst-pU6-hHIF1α#11 and negative control plasmid pCMS-Angst-pU6-NC expressed human angiostatin protein in HEK 293 cells in a dose and time dependent manner. Serial doses of plasmids pCMS-Angst-pU6-hHIF1α#11 and pCMS-Angst-pU6-NC (0.5 µg, 1 µg, and 2 µg) or controls (plasmids pCMS-pU6-hHIF1α#11 or pCMS-pU6-NC) were transfected into HEK 293 cells. Human angiostatin protein levels were measured in cell supernatants by ELISA at 24 hours and 48 hours after hypoxia induction.

Plasmids pCMS-Angst-pU6-hHIF1-alpha#11 and pCMS-Angst-pU6-NC expressed human angiostatin protein in a dose and time dependent manner (FIG. 9). No human angiostatin protein signals were detected supernatants from cells transfected with negative control plasmids without angiostatin (intermediate plasmids pCMS-pU6-hHIF1-alpha# 1 or pCMS-pU6-NC.

Figure 10:
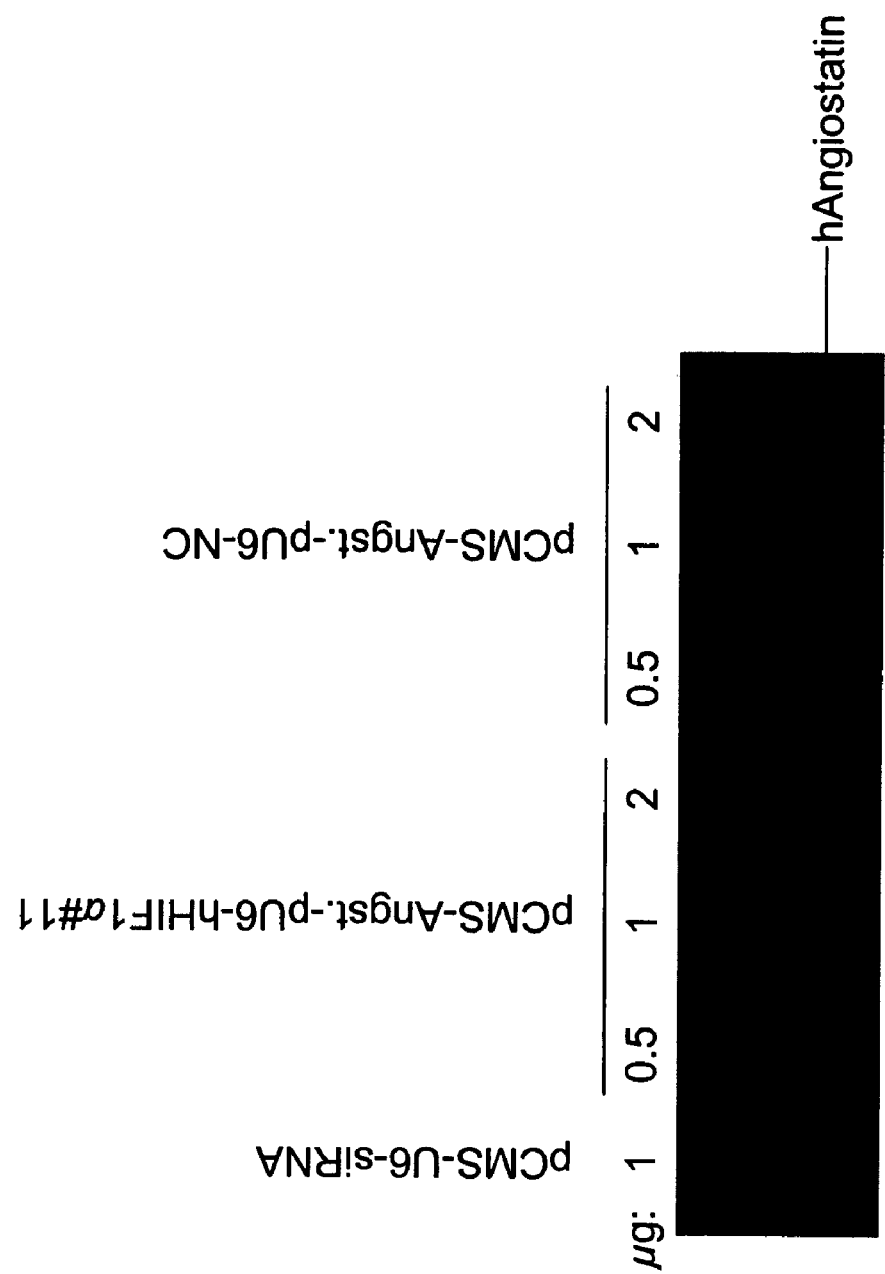
FIG. 10 is a photograph of an agarose gel electrophoresis showing that plasmids pCMS-Angst-pU6-hHIF1α#11 and negative control plasmid pCMS-Angst-pU6-NC expressed human angiostatin in a dose dependent manner at the transcriptional level. RNAs from HEK 293 cells transfected with different 0.5 µg, 1 µg, and 2 µg of these plasmids or negative control plasmids pCMS-pU6-hHIF1α#11 or pCMS-pU6-NC were extracted, and RT-PCR of human angiostatin mRNA was performed.

Human angiostatin mRNA levels in HEK 293 cells transfected with plasmids pCMS-Angst-pU6-hHIF1-alpha#11 and pCMS-Angst-pU6-NC varied in response to the amount of plasmid (FIG. 10). No human angiostatin mRNA was detected in HEK 293 cells transfected with negative control plasmids without angiostatin pCMS-pU6-hHIF1-alpha#11 or pCMS-pU6-NC.

Desferrioxamine-mediated hypoxia caused slight cytotoxicity to HEK 293 cells (FIG. 11). Transfection of HEK 293 cells with plasmids pCMS-Angst-pU6-hHIF1-alpha#11 and pCMS-Angst-pU6-NC showed no apparent cytotoxicity, as compared with transfection of these cells with negative control plasmids or mock transfection.

Example 3

Construction of Adeno-Associated Viral Vector Expressing RNAi Compounds

The nucleotide sequences encoding the anti-angiogenic compound (PEDF or angiostatin) and the siRNA will be excised from plasmids pCMS-PEDF-pU6-HVEGF#5; pCMS-PEDF-pU6-hVEGF#2 and pCMS-Angst-pU6-hHIF1-alpha#11, and inserted in between the inverted terminal repeats of a commercially available adeno-associated viral (AAV) plasmid. Recombinant AAV vector will be prepared by using the three-plasmid cotransfection system as described, for example, in Matsushita, T., 1998, *Gene Ther.* 5, 938-945, the entire disclosure of which is herein incorporated by reference. Briefly, the AAV vector will be cotransfected with two helper plasmids (Avigen, Alameda, Calif.) into HEK 293 cells by the CaPi precipitate method. One helper plasmid, pLadeno5, will contain the adenoviral VA, E2A, and E4 regions that mediate AAV vector replication. The other helper plasmid, pHLP19, will have the AAV rep and cap genes. Cell lysates will be produced by using three freeze-and-thaw cycles 3 days after the transfection. Recombinant AAV vector will be purified by $CsCl_2$ centrifugation, and viral titers will be determined by dot blot analysis of the DNA content. It is expected that the recombinant AAV vectors will infect target cells and express the PEDF or angiostatin and the appropriate siRNA. The protein and mRNA levels of the pro- or anti-angiogenic genes in the target cells are expected to be increased or decreased as reported above for the HEK 293 cells in Examples 1 and 2.

SEQUENCE LISTING (1737 sequences)

SEQ ID NO: 1 - DNA, 444 bp, Homo sapiens
atgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaatgtgacaagccgaggcggtga

SEQ ID NO: 2 - DNA, 576 bp, Homo sapiens
atgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtga

SEQ ID NO: 3 - DNA, 648 bp, Homo sapiens
atgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccggtataagtcctggagcgttccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtga

SEQ ID NO: 4 - DNA, 670 bp, Homo sapiens
gccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaggatagagcaagacaagaaaaaaaatcagttcgaggaaagggaaaggggcaaaaacgaaagcgcaagaaatcccggtataagtcctggagcgtttacgttggtgcccgctgctgtctaatgccctggagcctccctggcccccatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgatgaatga

SEQ ID NO: 5 - DNA, 2250 bp, Mus musculus
tgagccaggctggcaggaaggagcctccctcagggtttcgggaaccagacctctcaccggaaagaccgattaaccatgtcaccaccacgccatcatcgtcaccgttgacagaacagtccttaatccagaaagcctgacatgaaggaagaggagactcttcgaggagcactttgggtccggagggcgagactccggcagacgcattcccgggcaggtgaccaagcacggtccctcgtgggactggattcgccattttcttatatctgctgctaaatcgccaagcccggaagattagggttgtttctgggattcctgtagacacacccacccacatacacacatatatatatattatatatataaataaatatatatgttttatatataaaatatatatatattcttttttttaaattaactctgctaatgttattggtgtcttcactggatatgtttgactgctgtggacttgtgttgggaggaggatgtcctcactcggatgccgacatgggagacaatgggatgaaaggcttcagtgtggtctgagagaggccgaagtccttttgcctgccggggagcaagcaaggccagggcacgggggcacattggctcacttccagaaacacgacaaacccattcctggccctgagtcaagaggacagagagacagatgatgacacagaaagagataaagatgccggttccaaccagaagtttggggagcctcaggacatggcatgctttgtggatccccatgatagtctacaaaagcaccccgcccctctgggcactgcctggaagaatcgggagcctggccagccttcagctcgctcctccacttctgaggggcctaggaggcctcccacaggtgtcccggcaagagaagacacggtggtggaagaagaggcctggtaatggcccctcctcctgggaccccttcgtcctctccttaccccacctcctgggtacagcccaggaggaccttgtgtgatcagaccattgaaaccactaattctgtccccaggagacttggctctgtgtgtgagtggcttacccttcctcatcttcccttcccaaggcacagagcaatggggcaggacccgcaagcccctcacggaggcagagaaaagagaaagtgttttatatacggtacttatttaatagccctttttaattagaaattaaaacagttaatttaattaaagagtagggtttttttcagtattcttggttaatatttaatttcaactatttatgagatgtatctctcgctctctcttatttgtacttatgtgtgtgtgtgtgtgtgtgtgtgtgtgtgtgtgtgtgtgtatgaaatctgtgtttccaatctctctctcccagatcggtgacagtcactagcttgtcctgagaagatatttaattttgctaacactcagctctgccctcccttgtccccaccacacattcctttgaaataaggtttcaatatacatttacatactatatatatatttggcaacttgtgtttgtatataaatatatatatatatatatgtttatgtatatatgtgattctgataaaatagacattgctattctgttttttatatgtaaaaacaaaacaagaaaaatagagaattctacatactaaatctctctccttttttaattttaatatttgttatcatttatttattggtgctactgtttatccgtaataattgtgggggaaaaagatattaacatcacgtctttgtctctagagcagttttccgagatattccgtagtacatatttatttttaaacagcaacaaagaaatacagatatatcttaaaaaaaaagcattttgtattaaagaattgaattctgatctcaaagctctccctggtctctccttctctcctgggccctcctgtctcgctttccctcctcctttggggtacatagtttttgtcttaggtttgagaagcagtccctggagtagaatatggggtgacccatccattcctgggcggaggggagatggctcctttgccaagggtcctcacactacgtggtactctgttccttgtcagacaaggatgggggcatgtctccaggtgctaactggagatcggagagagctgttggctgcagctggccaggatttgggcatgccggggacatgggaggctgtgagcccagcatgcagtttacttctgggtgctaaatggaagagtccagtaaaaagagtcttgcccatgggattccattccgctttgtg

SEQ ID NO: 6 - DNA, 1137 bp, Homo sapiens
atgctcattgtccagactggggtcagatcagcaaacaaagggcctctgatggtgattgttgaatattgcaaatatggaaatctatccaactacctcaagagcaaatatgacttattttttctcgacaaggatgtggcatcacacatggagcgtaagaaagaaaaaatggagccaggcctggaacaaggcaagaaaccaaaactagatagcatcaccagcagcgagagctttgggagctccaagtttcaggaagataaaaatctgagtgatgttgaggaagaggaggattctgatggtttctaccaggagcccatcactatggaagatctgatttcttacagttttcaagtggccagaggcatgaagtttctgtcttccagaaagtgcattcattgggacctggcagcaagaaacattcttttatctgagaacaatgtggtgaagatttgtgattttggccttgcccaggatatttacaagaacgccgattatgtgagaaaaggaggtgggtctccatacccaggagtgcaaatggatgagcacttctgcagttgcctgagggaaggcatgaggatgagagctgctgagtactccactcctgaaatctatcagatcatgctggactgcaggcacaaagacccaaaagaaaggccaagatttgcagaacttgtggaaaaactagaaaatagtgggtttacatactcaactcctgccttctctgaggacttcttcaaggaaggtatttcagctcccaagtttagttcaggaagctctgatgatgtcagatacgtaaatgctttcaagttcatgagcctggaaagaatcaaaacctttgaagaacttttgccaaatgccacctccatgtttgatgactaccagggggacagcagcgctctgctggcctctcccatgctgaagcgcttcaccaggactgacagcaaacccaaggcctcgctcaagattgacttgagactaactagcaaaagtaagaagtcggggctttctgatgtcagcaggcccagtttctgccattccaacagtgggcacatcagcaaaggcaagggcaggttcacctacgacaacgccgagctggaaaggaagacggcgtgctgctccccgcccctctgggagttgtag

SEQ ID NO: 7 - DNA, 5830 bp, Homo sapiens
actgagtcccgggaccccgggagagcggtcagtgtgtggtcgctgcgtttcctctgcctgcgccgggcatcacttgcgcgccgcagaaagtccgtctggcagcctggatatcctctcctaccggcacccgcagacgcccctgcagccgccggtcggcgcccgggctccctagccctgtgcgctcaactgtcctgcgctgcggggtgccgcgagttccacctccgcgcctccttctctagacaggcgctgggagaaagaaccggctcccgagttctgggcatttcgcccggctcgaggtgcaggatgcagagcaaggtgctgctggccgtcgccctgtggctctgcgtggagacccgggccgcctctgtgggtttgcctagtgtttctcttgatctgcccaggctcagcatacaaaaagacatacttacaattaaggctaatacaactcttcaaattacttgcaggggacagagggacttggactggctttggcccaataatcagagtggcagtgagcaaagggtggaggtgactgagtgcagcgatggcctcttctgtaagacactcacaattccaaaagtgatcggaaatgacactggagcctacaagtgcttctaccgggaaactgacttggcctcggtcatttatgtctatgttcaagattacagatctccatttattgcttctgttagtgaccaacatggagtcgtgtacattactgagaacaaaaacaaaactgtggtgattccatgtctcgggtccatttcaaatctcaacgtgtcactttgtgcaagatacccagaaaagagatttgttcctgatggtaacagaatttcctgggacagcaagaagggctttactattcccagctacatgatcagctatgctggcatggtcttctgtgaagcaaaaattaatgatgaaagttaccagtctattatgtacatagttgtcgttgtagggtataggatttatgatgtggttctgagtccgtctcatggaattgaactatctgttggagaaaagcttgtcttaaattgtacagcaagaactgaactaaatgtggggattgacttcaactgggaatacccttcttcgaagcatcagcataagaaacttgtaaaccgagacctaaaaacccagtctgggagtgagatgaagaaatttttgagcaccttaactatagatggtgtaacccggagtgaccaaggattgtacacctgtgcagcatccagtgggctgatgaccaagaagaacagcacatttgtcagggtccatgaaaaaccttttgttgcttttggaagtggcatggaatctctggtggaagccacggtgggggagcgtgtcagaatccctgcgaagtaccttggttacccacccccagaaataaaatggtataaaaatggaataccccttgagtccaatcacacaattaaagcggggcatgtactgacgattatggaagtgagtgaaagagacacaggaaattacactgtcatccttaccaatcccatttcaaaggagaagcagagccatgtggtctctctggttgtgtatgtcccaccccagattggtgagaaatctctaatctctcctgtggattcctaccagtacggcaccactcaaacgctgacatgtacggtctatgccattcctcccccgcatcacatccactggtattggcagttggaggaagagtgcgccaacgagcccagccaagctgtctcagtgacaaacccatacccttgtgaagaatggagaagtgtggaggacttccagggaggaaataaaattgaagttaataaaaatcaatttgctctaattgaaggaaaaaacaaaactgtaagtacccttgttatccaagcggcaaatgtgtcagctttgtacaaatgtgaagcggtcaacaaagtcgggagaggagagagggtgatctccttccacgtgaccaggggtcctgaaattactttgcaacctgacatgcagcccactgagcaggagagcgtgtctttgtggtgcactgcagacagatctacgtttgagaacctcacatggtacaagcttggcccacagcctctgccaatccatgtgggagagttgcccacacctgtttgcaagaacttggatactctttggaaattgaatgccaccatgttctctaatagcacaaatgacattttgatcatggagcttaagaatgcatccttgcaggaccaaggagactatgtctgccttgctcaagacaggaagaccaagaaaagacattgcgtggtcaggcagctcacagtcctagagcgtgtggcacccacgatcacaggaaacctggagaatcagacgacaagtattggggaaagcatcgaagtctcatgcacggcatctgggaatccccctccacagatcatgtggtttaaagataatgagacccttgtagaagactcaggcattgtattgaaggatgggaaccggaacctcactatccgcagagtgaggaaggaggacgaaggcctctacacctgccaggcatgcagtgttcttggctgtgcaaaagtggaggcatttttcataatagaaggtgcccaggaaaagacgaacttggaaatcattattctagtaggcacggcggtgattgccatgttcttctggctacttcttgtcatcatcctacggaccgttaagcgggccaatggaggggaactgaagacaggctacttgtccatcgtcatggatccagatgaactcccattggatgaacattgtgaacgactgccttatgatgccagcaaatgggaattccccagagaccggctgaagctaggtaagcctcttggccgtggtgcctttggccaagtgattgaagcagatgcctttggaattgacaagacagcaacttgcaggacagtagcagtcaaaatgttgaaagaaggagcaacacacagtgagcatcgagctctcatgtctgaactcaagatcctcattcatattggtcaccatctcaatgtggtcaaccttctaggtgcctgtaccaagccaggagggccactcatggtgattgtggaattctgcaaatttggaaacctgtccacttacctgaggagcaagagaaatgaatttgtcccctacaagaccaaaggggcacgattccgtcaagggaaagactacgttggagcaatccctgtggatctgaaacggcgcttggacagcatcaccagtagccagagctcagccagctctggatttgtggaggagaagtccctcagtgatgtagaagaagaggaagctcctgaagatctgtataaggacttcctgaccttggagcatctcatctgttacagcttccaagtggctaagggcatggagttcttggcatcgcgaaagtgtatccacagggacctggcggcacgaaatatcctcttatcggagaagaacgtggttaaaatctgtgactttggcttggcccgggatatttataaagatccagattatgtcagaaaaggagatgctcgcctccctttgaaatggatggccccagaaacaatttttgacagagtgtacacaatccagagtgacgtctggtcttttggtgttttgctgtgggaaatattttccttaggtgcttctccatatcctggggtaaagattgatgaagaattttgtaggcgattgaaagaaggaactagaatgagggcccctgattatactacaccagaaatgtaccagaccatgctggactgctggcacggggagcccagtcagagacccacgttttcagagttggtggaacatttgggaaatctcttgcaagctaatgctcagcaggatggcaaagactacattgttcttccgatatcagagactttgagcatggaagaggattctggactctctctgcctacctcacctgtttcctgtatggaggaggaggaagtatgtgaccccaaattccattatgacaacacagcaggaatcagtcagtatctgcagaacagtaagcgaaagagccggcctgtgagtgtaaaaacatttgaagatatcccgttagaagaaccagaagtaaaagtaatcccagatgacaaccagacggacagtggtatggttcttgcctcagaagagctgaaaactttggaagacagaaccaaattatctccatcttttggtggaatggtgcccagcaaaagcagggagtctgtggcatctgaaggctcaaaccagacaagcggctaccagtccggatatcactccgatgacacagacaccaccgtgtactccagtgaggaagcagaacttttaaagctgatagagattggagtgcaaaccggtagcacagcccagattctccagcctgactcggggaccacactgagctctcctcctgtttaaaaggaagcatccacaccccaactcccggacatcacatgagaggtctgctcagattttgaagtgttgttctttccaccagcaggaagtagccgcatttgattttcatttcgacaacagaaaaaggacctcggactgcagggagccagtcttctaggcatatcctggaagaggcttgtgacccaagaatgtgtctgtgtcttctcccagtgttgacctgatcctcttttttcattcatttaaaaagcattatcatgcccctgctgcgggtctcaccatgggtttagaacaaagagcttcaagcaatggccccatcctcaaagaagtagcagtacctggggagctgacacttctgtaaaactagaagataaaccaggcaacgtaagtgttcgaggtgttgaagatgggaaggatttgcagggctgagtctatccaagaggctttgtttaggacgtgggtcccaagccaagccttaagtgtggaattcggattgatagaaaggaagactaacgttaccttgctttggagagtactggagcctgcaaatgcattgtgtttgctctggtggaggtgggcatggggtctgttctgaaatgtaaagggttcagacggggtttctggttttagaaggttgcgtgttcttcgagttgggctaaagtagagttcgttgtgctgtttctgactcctaatgagagttccttccagaccgttagctgtctccttgccaagccccaggaagaaaatgatgcagctctggctccttgtctcccaggctgatcctttattcagaataccacaaagaaaggacattcagctcaaggctccctgccgtgttgaagagttctgactgcacaaaccagcttctggtttcttctggaatgaataccctcatatctgtcctgatgtgatatgtctgagactgaatgcgggaggttcaatgtgaagctgtgtgtggtgtcaaagtttcaggaaggattttacccttttgttcttccccctgtccccaacccactctcaccccgcaacccatcagtattttagttatttggcctctactccagtaaacctgattgggtttgttcactctctgaatgattattagccagacttcaaaattattttatagcccaaattataacatctattgtattatttagacttttaacatatagagctatttctactgatttttgcccttgttctgtcctttttttcaaaaaagaaaatgtgttttttgtttggtaccatagtgtgaaatgctgggaacaatgactataagacatgctatggcacatatatttatagtctgtttatgtagaaacaaatgtaatatattaaagccttatatataatgaactttgtactattcacattttgtatcagtattatgtagcataacaaaggtcataatgctttcagcaattgatgtcattttattaaagaacattgaaaaacttga

SEQ ID NO: 8 - DNA, 2964 bp, Homo sapiens
ggccgtccctggcggcggagatggcggcgacagcggcggaggctgtgacctctggctctggagagccccgggaggaggctggagccctcggccccgcctggcatgaatcccagttgcgcagttatagcttcccgactaggcccattccgcgtctgagtcagagcgacccccgggcagaggagcttattgagaatgaggagcctgtggtgctgaccgacacaaatcttgtgtatcctgccctgaaatgggaccttgaatacctgcaagagaatattggcaatggagacttctctgtgtacagtgccagcacccacaagttcttgtactatgatgagaagaagatggccaatttccagaactttaagccgaggtccaacagggaagaaatgaaatttcatgagttcgttgagaaactgcaggatatacagcagcgaggaggggaagagaggttgtatctgcagcaaacgctcaatgacactgtgggcgggaagattgtcatggacttcttaggttttaactggaactggattaataagcaacagggaaagcgtggctgggggcagcttacctctaacctgctgctcattggcatggaaggaaatgtgacacctgctcactatgatgagcagcagaacttttttgctcagataaaaggttacaaacgatgcatcttattccctccggatcagttcgagtgcctctacccataccctgttcatcacccatgtgacagacagagccaggtggactttgacaatcccgactacgagaggttccctaatttccaaaatgtggttggttacgaaacagtggttggccctggtgatgttctttacatcccaatgtactggtggcatcacatagagtcattactaaatggggggattaccatcactgtgaacttctggtataagggggctcccacccctaagagaattgaatatcctctcaaagctcatcagaaagtggccataatgagaaacattgagaagatgcttggagaggccttggggaacccacaagaggtggggcccttgttgaacacaatgatcaagggccggtacaactagcctgccaggggtcaaggcctcctgccaggtgactgctatcccgtccacaccgcttcattgatgaggacaggagactccaagcgctagtattgcacgctgcacttaatggactggactcttgccatggcccaggagtcaggtgtttggagcgaggcagggcagttggcactccactcctatttggagggacttcatacccttgcctcttgtgccccagcaccttctctctctgccccccgcctaaagtcctgcattcagtgtgtggagtcccagcttttggttgtcatcatgtctgtgtgtatgttagtctgtcaacttcggaatgtgtgcgtgtgtgtgcatgcacacgcatgtatgtatctgttccctgttccttctgggtcaggctgtcacttccggctctcggccctatctcctgcaacctcagtgcctcagcctgagagagagatgagatgctcttggactccccactgcatctgggctgcagggccagagctagtctgaccattaggtcagtctgcctcctgacagtttttgcgtagtcaagctctaggcggtatgggaatggctaccgggactctaatggggtgaaagagaggggaggcttgcctttgagagcctatatagccttcctgtgagagaggattagatagggttccaactgggcctacaagctcaagccatacataaaaggaccttgggacataagaaccaatgattgtgcataagttctaaattagagacacatatagtttctctctttcagcaccagctcttgcccctatgctgggtaccaagggagttctcctagctgtggcttctctaggttctaggggtgcaagcctctgtgtgtttgtttgtgtgtgtctgtgtgtgcgtatccacactaggggtgcaagcctctgggtgtgtgtgtgtgtgtgcgtgcgtgtgtgtgtgtgtgtccgtgtgtgtgtgtgtgtgtccacactggccagcctccctacttaccaaggttctccactgcttaccttttccagtgggacagtacagtgtgagcccccgggaagtactgcctgacctatcctaagcttttacacttggattttagccatcatatgttggccaggtttcactgcagcctgcccgaggctaactggctagagcctccaggccctatgatgctccctgcccaggccatatcctttattcctgctgagcttcctggctgaatagatgaaatggggtcaagcccaggcagctcattcactatctgtgatccacctcagggcacgggcaaacacataggcttgcgtcttaaagccagctcctctgccagaccccgttgtaatgtgccacaacaccctcaatagtcagggcaactggtggagcatggaagtcgaatttccttttctgttaggagctactcctgggaacccctctcagggctgcagcttacaggtgggcagctgtgattgcacaacttgaagggccatcattcacatctattcagtgggagtggggtccctgggattgggcagtgtggtggccctgtgtctcctcacctctgctcctgtcttcatcaccttctctctggaagggaagaggagttggaaggtctctggttttcttttctttttttttttttgccaaaggtttacttccagcatctgagctctggctctcacccctgaagctcagttatagtgcactgatgaactgagaggatgcgtgtggatgtgtgtgcatgcctgagtgcgttttttggggaggggtgtttatttttagtaccccattctggggttctctgatgcagtgtggatgtgaagatatggtaccttctcaagtgtagctctttcaaatatagtcaatgctgggaaaaaaaaaaaaaaaaaaaaaaaaaaaaaaaaaaaaa

SEQ ID NO: 9 - DNA, 3958 bp, Homo sapiens
gtgctgcctcgtctgaggggacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacctaaagcagtctatttatattttctacatctaattttagaagcctggctacaatactgcacaaacttggttagttcaatttttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccaggaaaaaaaaaaaaaaaaaaa

SEQ ID NO: 10 - DNA, 3812 bp, Homo sapiens
gtgctgcctcgtctgaggggacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacctaaagcagtctatttatattttctacatctaattttagaagcctggctacaatactgcacaaacttggttagttcaatttttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccagg

SEQ ID NO: 11 - DNA, 3718 bp, Rattus norvegicus
gacaccgcgggcaccgattcgccatggagggcgccggcggcgagaacgagaagaaaaataggatgagttccgaacgtcgaaaagaaaagtctagggatgcagcacgatctcggcgaagcaaagagtctgaagttttttatgagcttgctcatcagttgccacttccccacaacgtgagctcccatcttgataaagcttctgttatgaggctcaccatcagttacttacgtgtgaggaaacttctaggtgctggtgatcttgacattgaagatgaaatgaaagcacagatgaactgcttttatctgaaagccctggatggctttgttatggtgctaacagatgatggtgacatgatttacatttctgataacgtgaacaaatacatggggttgactcagtttgaactaactggacacagtgtgtttgattttacccatccatgtgaccatgaggaaatgagagaaatgcttacacacagaaatggcccagtgagaaaggggaaagaacaaaacacgcagcgaagcttttttctcagaatgaaatgtaccctaacaagccgggggaggacgatgaacatcaagtcagcaacgtggaaggtgctgcactgcacaggccacattcatgtgtatgataccagcagtaaccagccgcagtgtggctacaagaaaccgcctatgacgtgcttggtgctgatttgtgaacccattcctcatccatcaaacattgaaattcctttagacagcaagacatttctcagtcgacacagcctcgatatgaaattttcttactgtgatgaaaggattactgagttgatgggttatgagccagaagaacttttgggccgttcaatttatgaatattatcatgctttggactctgatcatctgaccaaaactcatcatgacatgtttactaaaggacaagtcaccacaggacagtacaggatgcttgcaaaaagaggtggatatgtctgggttgagactcaagcaactgttatatataatacgaagaactctcagccacagtgcattgtgtgtgtgaattatgttgtaagtggtattattcagcacgacttgattttctcccttcaacaaacagaatctgtcctcaaaccagttgaatcttcagatatgaaaatgacccagctgttcactaaagtggaatctgaggacacgagctgcctcttcgacaagcttaagaaagagcccgatgccctgactctgctagctccagcggctggggacacgatcatatcactggacttcggcagcgatgacacggaaactgaagaccaacaacttgaagatgtcccgttgtacaatgatgtaatgttcccctcttctaatgagaaattaaatataaatctggcaatgtctccattacctgcctctgaaactccaaagccacttcgaagtagtgctgatcctgcactgaatcaagaggttgcattgaagttagagtcaagcccagagtcactgggactttcttttaccatgccccagattcaagatcagccagcaagtccttctgatggaagcactagacaaagctcacctgagcctaacagtcccagtgagtactgctttgatgtggacagcgatatggtcaatgtattcaagttggaactggtggaaaaactgtttgctgaagacacagaagcgaagaatccattttcagctcaggacactgatttagacttggaaatgctggctccctatatcccaatggatgatgatttccagttacgttcctttgatcagttgtcaccattagagagcaattctccaagccctccgagtgtgagcacagttacaggattccagcagacccagttacagaaacctaccatcactgtcactgccaccgcaactgccaccactgatgaatcaaaagcagtgacgaaggacaatatagaagacattaaaatactgattgcatctccaccttctacccaagtacctcaagaaatgaccactgctaaggcatcagcatacagtggtactcacagtcggacagcctcaccagacagagcaggaaagagagtcatagaaaaaacagacaaagctcatccaaggagccttaacctatctgtcactttgaatcaaagaaatactgttcctgaagaagaattaaacccaaagacaatagctttgcagaatgctcagaggaagcgaaaaatggaacatgatggctccctttttcaagcagcaggaattggaacgttactgcagcaaccaggtgaccgtgcccctactatgtcgctttcttggaaacgagtgaaaggatacatatctagtgaacaggatggaatggagcagaagacaatttttttaataccctctgatttagcatgtagactgctggggcagtcaatggatgagagtggattaccacagctgaccagttacgattgtgaagttaatgctcccatacaaggcagcagaaacctactgcagggtgaagaattactcagagctttggatcaagttaactgagcttttcctaatctcattcctttgattgttaatttttgtgttcagttgttgttgttgtctgtggggtttcgtttctgttggttgttttggacactggtggctcagcagtctatttatattttctatatctcatttagaggcctggctacagtactgcaccaactcagatagtttagtttgggccccttcctccttcattttcactgatgctctttttaccatgtccttcgaatgccagatcacagcacattcacagctccccagcatttcaccaatgcattgctgtagtgtcgtttaaaatgcacctttttatttatttatttttggtgagggagtttgtcccttattgaattatttttaatgaaatgccaatataattttttaagaaggcagtaaatcttcatcatgatgataggcagttgaaaattttttactcatttttttcatgttttacatgaaaataatgctttgccagcagtacatggtagccacaattgcacaatatattttcttaaaaataccagcagttactcatgcatatattctgcatttataaaactagtttttaagaagaaactttttttggcctatggaattgttaagcctggatcatgatgctgttgatcttataatgattcttaaactgtatggtttctttatatgggtaaagccatttacatgatatagagagatatgcttatatctggaaggtatatggcatttatttggataaaattctcaattgagaagttatctggtgtttctttactttaccggctcaaaagaaaacagtccctatgtagttgtggaagcttatgctaatattgtgtaattgatattaaacattaaatgttctgcctatcctgttggtataaagacattttgagcatactgtaaacaaaaaaatcatgcattgttagtaaaattgcctagtatgttaatttgttgaaaatacgatgtttggttttatgcactttgtcgctattaacatcctttttttcatatagatttcaataattgagtaattttagaagcattattttagaaatatagagttgtcatagtaaacatcttgtttttttttctttttttctatgtacattgtataaatttttcattcccttgctctttgtagttgggtctaacactaactgtactgttttgttatatcaaataaacatcttctgtggaccaggaaaaaaaaaaaaaaaaaaaaaaaaaaa

SEQ ID NO: 12 - DNA, 3973 bp, Mus musculus
cgcgaggactgtcctcgccgccgtcgcgggcagtgtctagccaggccttgacaagctagccggaggagcgcctaggaacccgagccggagctcagcgagcgcagcctgcacgcccgcctcgcgtcccgggggggtcccgcctcccaccccgcctctggacttgtctctttccccgcgcgcgcggacagagccggcgtttaggcccgagcgagcccgggggccgccggccgggaagacaacgcgggcaccgattcgccatggagggcgccggcggcgagaacgagaagaaaaagatgagttctgaacgtcgaaaagaaaagtctagagatgcagcaagatctcggcgaagcaaagagtctgaagttttttatgagcttgctcatcagttgccacttccccacaatgtgagctcacatcttgataaagcttctgttatgaggctcaccatcagttatttacgtgtgagaaaacttctggatgccggtggtctagacagtgaagatgagatgaaggcacagatggactgtttttatctgaaagccctagatggctttgtgatggtgctaacagatgacggcgacatggtttacatttctgataacgtgaacaaatacatggggttaactcagtttgaactaactggacacagtgtgtttgattttactcatccatgtgaccatgaggaaatgagagaaatgcttacacacagaaatggcccagtgagaaaagggaaagaactaaacacacagcggagcttttttctcagaatgaagtgcaccctaacaagccgggggaggacgatgaacatcaagtcagcaacgtggaaggtgcttcactgcacgggccatattcatgtctatgataccaacagtaaccaacctcagtgtgggtacaagaaaccacccatgacgtgcttggtgctgatttgtgaacccattcctcatccgtcaaatattgaaattcctttagatagcaagacatttctcagtcgacacagcctcgatatgaaattttcttactgtgatgaaagaattactgagttgatgggttatgagccggaagaacttttgggccgctcaatttatgaatattatcatgctttggattctgatcatctgaccaaaactcaccatgatatgtttactaaaggacaagtcaccacaggacagtacaggatgcttgccaaaagaggtggatatgtctgggttgaaactcaagcaactgtcatatataatacgaagaactcccagccacagtgcattgtgtgtgtgaattatgttgtaagtggtattattcagcacgacttgattttctcccttcaacaaacagaatctgtgctcaaaccagttgaatcttcagatatgaagatgactcagctgttcaccaaagttgaatcagaggatacaagctgcctttttgataagcttaagaaggagcctgatgctctcactctgctggctccagctgccggcgacaccatcatctctctggattttggcagcgatgacacagaaactgaagatcaacaacttgaagatgttccattatataatgatgtaatgtttccctcttctaatgaaaaattaaatataaacctggcaatgtctcctttaccttcatcggaaactccaaagccacttcgaagtagtgctgatcctgcactgaatcaagaggttgcattaaaattagaatcaagtccagagtcactgggactttcttttaccatgccccagattcaagatcagccagcaagtccttctgatggaagcactagacaaagttcacctgagagacttcttcaggaaaacgtaaacactcctaacttttcccagcctaacagtcccagtgaatattgctttgatgtggatagcgatatggtcaatgtattcaagttggaactggtggaaaaactgtttgctgaagacacagaggcaaagaatccattttcaactcaggacactgatttagatttggagatgctggctccctatatcccaatggatgatgatttccagttacgttcctttgatcagttgtcaccattagagagcaattctccaagccctccaagtatgagcacagttactgggttccagcagacccagttacagaaacctaccatcactgccactgccaccacaactgccaccactgatgaatcaaaaacagagacgaaggacaataaagaagatattaaaatactgattgcatctccatcttctacccaagtacctcaagaaacgaccactgctaaggcatcagcatacagtggcactcacagtcggacagcctcaccagacagagcaggaaagagagtcatagaacagacagacaaagctcatccaaggagccttaagctgtctgccactttgaatcaaagaaatactgttcctgaggaagaattaaacccaaagacaatagcttcgcagaatgctcagaggaagcgaaaaatggaacatgatggctccctttttcaagcagcaggaattggaacattattgcagcaaccaggtgactgtgcacctactatgtcactttcctggaaacgagtgaaaggattcatatctagtgaacagaatggaacggagcaaaagactattattttaataccctccgatttagcatgcagactgctggggcagtcaatggatgagagtggattaccacagctgaccagttacgattgtgaagttaatgctcccatacaaggcagcagaaacctactgcagggtgaagaattactcagagctttggatcaagttaactgagcgtttcctaatctcattccttttgattgttaatgtttttgttcagttgttgttgtttgttgggtttttgtttctgttggttatttttggacactggtggctcagcagtctatttatattttctatatctaattttagaagcctggctacaatactgcacaaactcagatagtttagttttcatcccctttctacttaattttcattaatgctctttttaatatgttcttttaatgccagatcacagcacattcacagctcctcagcatttcaccattgcattgctgtagtgtcatttaaaatgcacctttttatttatttatttttggtgagggagtttgtcccttattgaattatttttaatgaaatgccaatataattttttaagaaagcagtaaattctcatcatgatcataggcagttgaaaactttttactcatttttttcatgttttacatgaaaataatgctttgtcagcagtacatggtagccacaattgcacaatatattttctttaaaaaaccagcagttactcatgcaatatattctgcatttataaaactagtttttaagaaattttttttggcctatggaattgttaagcctggatcatgaagcgttgatcttataatgattcttaaactgtatggtttctttatatgggtaaagccatttacatgatataaagaaatatgcttatatctggaaggtatgtggcatttatttggataaaattctcaattcagagaagttatctggtgtttcttgactttaccaactcaaaacagtccctctgtagttgtggaagcttatgctaatattgtgtaattgattatgaaacataaatgttctgcccaccctgttggtataaagacattttgagcatactgtaaacaaacaaacaaaaaatcatgctttgttagtaaaattgcctagtatgttgatttgttgaaaatatgatgtttggttttatgcactttgtcgctattaacatccttttttcatatagatttcaataagtgagtaattttagaagcattattttaggaatatagagttgtcatagtaaacatcttgttttttctatgtacactgtataaatttttcgttcccttgctctttgtggttgggtctaacactaactgtactgttttgttatatcaaataaacatcttctgtggaccaggaaaaaaaaaaaaaaaaaa

SEQ ID NO: 13 - DNA, 2900 bp, Homo sapiens
gcgccccagtcgacgctgagctcctctgctactcagagttgcaacctcagcctcgctatggctcccagcagcccccggcccgcgctgcccgcactcctggtcctgctcggggctctgttcccaggacctggcaatgcccagacatctgtgtccccctcaaaagtcatcctgccccggggaggctccgtgctggtgacatgcagcacctcctgtgaccagcccaagttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttgtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcaaggtgaccgtgaatgtgctctccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggcccatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggccccacagacttacagaagaagtggccctccatagacatggcactgctgtctactgaccccaacccttgatgatatgtatttattcatttgttattttaccagctatttattgagtgtcttttatgtaggctaaatgaacataggtctctggcctcacggagctcccagtcctaatcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgattttttttttttttccagagacggggtctcgcaacattgcccagacttcctttgtgttagttaataaagctttctcaactgc

SEQ ID NO: 14 - DNA, 1614 bp, Mus musculus
atggcttcaacccgtgccaagcccacgctacctctgctcctggccctggtcaccgttgtgatccctgggcctggtgatgctcaggtatccatccatcccagagaagccttcctgccccagggtgggtccgtgcaggtgaactgttcttcctcatgcaaggaggacctcagcctgggcttggagactcagtggctgaaagatgagctcgagagtggacccaactggaagctgtttgagctgagcgagatcggggaggacagcagtccgctgtgctttgagaactgtggcaccgtgcagtcgtccgcttccgctaccatcaccgtgtattcgtttccggagagtgtggagctgagacctctgccagcctggcagcaagtaggcaaggacctcaccctgcgctgccacgtggatggtggagcaccgcggacccagctctcagcagtgctgctccgtggggaggagatactgagccgccagccagtgggtgggcaccccaaggaccccaaggagatcacattcacggtgctggctagcagaggggaccacggagccaatttctcatgccgcacagaactggatctcaggccgcaagggctggcattgttctctaatgtctccgaggccaggagcctccggactttcgatcttccagctaccatcccaaagctcgacacccctgacctcctggaggtgggcacccagcagaagttgttttgctccctggaaggcctgtttcctgcctctgaagctcggatatacctggagctgggaggccagatgccgacccaggagagcacaaacagcagtgactctgtgtcagccactgccttggtagaggtgactgaggagttcgacagaaccctgccgctgcgctgcgttttggagctagcggaccagatcctggagacgcagaggaccttaacagtctacaacttttcagctccggtcctgaccctgagccagctggaggtctcggaagggagccaagtaactgtgaagtgtgaagcccacagtgggtcgaaggtggttcttctgagcggcgtcgagcctaggccacccaccccgcaggtccaattcacactgaatgccagctcggaggatcacaaacgaagcttcttttgctctgccgctctggaggtggcgggaaagttcctgtttaaaaaccagaccctggaactgcacgtgctgtatggtcctcggctggacgagacggactgcttggggaactggacctggcaagaggggtctcagcagactctgaaatgccaggcctgggggaacccatctcctaagatgacctgcagacggaaggcagatggtgccctgctgcccatcggggtggtgaagtctgtcaaacaggagatgaatggtacatacgtgtgccatgcctttagctcccatgggaatgtcaccaggaatgtgtacctgacagtactgtaccactctcaaaataactggactataatcattctggtgccagtactgctggtcattgtgggcctcgtgatggcagcctcttatgtttataaccgccagagaaagatcaggatatacaagttacagaaggctcaggaggaggccataaaactcaagggacaagccccacctccctga

SEQ ID NO: 15 - DNA, 1493 bp, Homo sapiens
atgacagttttcctttcctttgctttcctcgctgccattctgactcacatagggtgcagcaatcagcgccgaagtccagaaaacagtgggagaagatataaccggattcaacatgggcaatgtgcctacactttcattcttccagaacacgatggcaactgtcgtgagagtacgacagaccagtacaacacaaacgctctgcagagagatgctccacacgtggaaccggatttctcttcccagaaacttcaacatctggaacatgtgatggaaaattatactcagtggctgcaaaaacttgagaattacattgtggaaaacatgaagtcggagatggcccagatacagcagaatgcagttcagaaccacacggctaccatgctggagataggaaccagcctcctctctcagactgcagagcagaccagaaagctgacagatgttgagacccaggtactaaatcaaacttctcgacttgagatacagctgctggagaattcattatccacctacaagctagagaagcaacttcttcaacagacaaatgaaatcttgaagatccatgaaaaaaacagtttattagaacataaaatcttagaaatggaaggaaaacacaaggaagagttggacaccttaaaggaagagaaagagaaccttcaaggcttggttactcgtcaaacatatataatccaggagctggaaaagcaattaaacagagctaccaccaacaacagtgtccttcagaagcagcaactggagctgatggacacagtccacaaccttgtcaatctttgcactaagaagttttactaaagggaggaaaaagagaggaagagaaaccatttagagactgtgcagatgtatatcaagctggttttaataaaagtggaatctacactatttatattaataatatgccagaacccaaaaaggtgttttgcaatatggatgtcaatgggggaggttggactgtaatacaacatcgtgaagatggaagtctagatttccaaagaggctggaaggaatataaaatgggttttggaaatccctccggtgaatattggctggggaatgagtttatttttgccattaccagtcagaggcagtacatgctaagaattgagttaatggactgggaagggaaccgagcctattcacagtatgacagattccacataggaaatgaaaagcaaaactataggttgtatttaaaaggtcacactgggacagcaggaaaacagagcagcctgatcttacacggtgctgatttcagcactaaagatgctgataatgacaactgtatgtgcaaatgtgccctcatgttaacaggaggatggtggtttgatgcttgtggcccctccaatctaaatggaatgttctatactgcgggacaaaaccatggaaaactgaatgggataaagtggcactacttcaaagggcccagttactccttacgttccacaactatgatgattcgacctttagatttttga

SEQ ID NO: 16 - DNA, 1497 bp, Homo sapiens
atgacagttttcctttcctttgctttcctcgctgccattctgactcacatagggtgcagcaatcagcgccgaagtccagaaaacagtgggagaagatataaccggattcaacatgggcaatgtgcctacactttcattcttccagaacacgatggcaactgtcgtgagagtacgacagaccagtacaacacaaacgctctgcagagagatgctccacacgtggaaccggatttctcttcccagaaacttcaacatctggaacatgtgatggaaaattatactcagtggctgcaaaaacttgagaattacattgtggaaaacatgaagtcggagatggcccagatacagcagaatgcagttcagaaccacacggctaccatgctggagataggaaccagcctcctctctcagactgcagagcagaccagaaagctgacagatgttgagacccaggtactaaatcaaacttctcgacttgagatacagctgctggagaattcattatccacctacaagctagagaagcaacttcttcaacagacaaatgaaatcttgaagatccatgaaaaaaacagtttattagaacataaaatcttagaaatggaaggaaaacacaaggaagagttggacaccttaaaggaagagaaagagaaccttcaaggcttggttactcgtcaaacatatataatccaggagctggaaaagcaattaaacagagctaccaccaacaacagtgtccttcagaagcagcaactggagctgatggacacagtccacaaccttgtcaatctttgcactaaagaaggtgttttactaaagggaggaaaaagagaggaagagaaaccatttagagactgtgcagatgtatatcaagctggttttaataaaagtggaatctacactatttatattaataatatgccagaacccaaaaaggtgttttgcaatatggatgtcaatgggggaggttggactgtaatacaacatcgtgaagatggaagtctagatttccaaagaggctggaaggaatataaaatgggttttggaaatccctccggtgaatattggctggggaatgagtttatttttgccattaccagtcagaggcagtacatgctaagaattgagttaatggactgggaagggaaccgagcctattcacagtatgacagattccacataggaaatgaaaagcaaaactataggttgtatttaaaaggtcacactgggacagcaggaaaacagagcagcctgatcttacacggtgctgatttcagcactaaagatgctgataatgacaactgtatgtgcaaatgtgccctcatgttaacaggaggatggtggtttgatgcttgtggcccctccaatctaaatggaatgttctatactgcgggacaaaaccatggaaaactgaatgggataaagtggcactacttcaaagggcccagttactccttacgttccacaactatgatgattcgacctttagatttttga

SEQ ID NO: 17 - DNA, 159 bp, Canis familiaris
aggaggaagtctagattttccaagaggttggaaagaatataaaatgggttttggaaatccctctggtgaatattggctggggaatgagtttatttttgccattaccagtcagaggcagtacacactaagaattgagttaatggactgggaaggaaaccc

SEQ ID NO: 18 - DNA, 2269 bp, Homo sapiens
tgggttggtgtttatctcctcccagccttgagggagggaacaacactgtaggatctggggagagaggaacaaaggaccgtgaaagctgctctgtaaaagctgacacagccctcccaagtgagcaggactgttcttcccactgcaatctgacagtttactgcatgcctggagagaacacagcagtaaaaaccaggtttgctactggaaaaagaggaaagagaagactttcattgacggacccagccatggcagcgtagcagccctgcgtttcagacggcagcagctcgggactctggacgtgtgtttgccctcaagtttgctaagctgctggtttattactgaagaaagaatgtggcagattgttttctttactctgagctgtgatcttgtcttggccgcagcctataacaactttcggaagagcatggacagcataggaaagaagcaatatcaggtccagcatgggtcctgcagctacactttcctcctgccagagatggacaactgccgctcttcctccagcccctacgtgtccaatgctgtgcagagggacgcgccgctcgaatacgatgactcggtgcagaggctgcaagtgctggagaacatcatggaaaacaacactcagtggctaatgaagcttgagaattatatccaggacaacatgaagaaagaaatggtagagatacagcagaatgcagtacagaaccagacggctgtgatgatagaaatagggacaaacctgttgaaccaaacagctgagcaaacgcggaagttaactgatgtggaagcccaagtattaaatcagaccacgagacttgaacttcagctcttggaacactccctctcgacaaacaaattggaaaaacagattttggaccagaccagtgaaataaacaaattgcaagataagaacagtttcctagaaaagaaggtgctagctatggaagacaagcacatcatccaactacagtcaataaaagaagagaaagatcagctacaggtgttagtatccaagcaaaattccatcattgaagaactagaaaaaaaaatagtgactgccacggtgaataattcagttcttcaaaagcagcaacatgatctcatggagacagttaataacttactgactatgatgtccacatcaaactcagctaaggaccccactgttgctaaagaagaacaaatcagcttcagagactgtgctgaagtattcaaatcaggacacaccacaaatggcatctacacgttaacattccctaattctacagaagagatcaaggcctactgtgacatggaagctggaggaggcgggtggacaattattcagcgacgtgaggatggcagcgttgattttcagaggacttggaaagaatataaagtgggatttggtaacccttcaggagaatattggctgggaaatgagtttgtttcgcaactgactaatcagcaacgctatgtgcttaaaatacaccttaaagactgggaagggaatgaggcttactcattgtatgaacatttctatctctcaagtgaagaactcaattataggattcaccttaaaggacttacagggacagccggcaaaataagcagcatcagccaaccaggaaatgattttagcacaaaggatggagacaacgacaaatgtatttgcaaatgttcacaaatgctaacaggaggctggtggtttgatgcatgtggtccttccaacttgaacggaatgtactatccacagaggcagaacacaaataagttcaacggcattaaatggtactactggaaaggctcaggctattcgctcaaggccacaaccatgatgatccgaccagcagatttctaaacatcccagtccacctgaggaactgtctcgaactattttcaaagacttaagcccagtgcactgaaagtcacggctgcgcactgtgtcctcttccaccacagagggcgtgtgctcggtgctgacgggacccacatgctccagattagagcctgtaaactttatcacttaaacttgcatcacttaacggaccaaagcaagaccctaaacatccataattgtgattagacagaacacctatgcaaagatgaacccgaggctgagaatcagactgacagtttacagacgctgctgtcacaaccaagaatgttatgtgcaagtttatcagtaaataactggaaaacagaacacttatgttatacaatacagatcatcttggaactgcattcttctgagcactgtttatacactgtgtaaatacccatatgtcct

SEQ ID NO: 19 - DNA, 1376 bp, Homo sapiens
ggtttattactgaagaaagaatgtggcagattgttttctttactctgagctgtgatcttgtcttggccgcagcctataacaactttcggaagagcatggacagcataggaaagaagcaatatcaggtccagcatgggtcctgcagctacactttcctcctgccagagatggacaactgccgctcttcctccagcccctacgtgtccaatgctgtgcagagggacgcgccgctcgaatacgatgactcggtgcagaggctgcaagtgctggagaacatcatggaaaacaacactcagtggctaatgaaggtattaaatcagaccacgagacttgaacttcagctcttggaacactccctctcgacaaacaaattggaaaaacagattttggaccagaccagtgaaataaacaaattgcaagataagaacagtttcctagaaaagaaggtgctagctatggaagacaagcacatcatccaactacagtcaataaaagaagagaaagatcagctacaggtgttagtatccaagcaaaattccatcattgaagaactagaaaaaaaaatagtgactgccacggtgaataattcagttcttcaaaagcagcaacatgatctcatggagacagttaataacttactgactatgatgtccacatcaaactcagctaaggaccccactgttgctaaagaagaacaaatcagcttcagagactgtgctgaagtattcaaatcaggacacaccacaaatggcatctacacgttaacattccctaattctacagaagagatcaaggcctactgtgacatggaagctggaggaggcgggtggacaattattcagcgacgtgaggatggcagcgttgattttcagaggacttggaaagaatataaagtgggatttggtaacccttcaggagaatattggctgggaaatgagtttgtttcgcaactgactaatcagcaacgctatgtgcttaaaatacaccttaaagactgggaagggaatgaggcttactcattgtatgaacatttctatctctcaagtgaagaactcaattataggattcaccttaaaggacttacagggacagccggcaaaataagcagcatcagccaaccaggaaatgattttagcacaaaggatggagacaacgacaaatgtatttgcaaatgttcacaaatgctaacaggaggctggtggtttgatgcatgtggtccttccaacttgaacggaatgtactatccacagaggcagaacacaaataagttcaacggcattaaatggtactactggaaaggctcaggctattcgctcaaggccacaaccatgatgatccgaccagcagatttctaaacatcccagtccacctgagga

SEQ ID NO: 20 - DNA, 2424 bp, Mus musculus
  misc_feature (2308)..(2308): n is a, c, g, or t
ggctgctccttcctctcaggacagctccgagtgtgccggggagaagagaagagaagagacaggcactgggaaagagcctgctgcgggacggagaaggctctcactgatggacttattcacacggcacagccctgtgccttagacagcagctgagagctcaggacgcaagtttgctgaactcacagtttagaacccaaaaagagagagagaatgtggcagatcattttcctaacttttggctgggatcttgtcttggcctcagcctacagtaactttaggaagagcgtggacagcacaggcagaaggcagtaccaggtccagaacggaccctgcagctacacgttcctgctgccggagaccgacagctgccgatcttcctccagcccctacatgtccaatgccgtgcagagggatgcacccctcgactacgacgactcagtgcaaaggctgcaggtgctggagaacattctagagaacaacacacagtggctgatgaagctggagaattacattcaggacaacatgaagaaggagatggtggagatccaacagaatgtggtgcagaaccagacagctgtgatgatagagattggaaccagcttgctgaaccagacagcagcacaaactcggaaactgactgatgtggaagcccaagtactaaaccagacgacaagactcgagctgcagcttctccaacattctatttctaccaacaaattggaaaagcagattttggatcagaccagtgaaataaacaagctacaaaataagaacagcttcctagaacagaaagttctggacatggagggcaagcacagcgagcagctacagtccatgaaggagcagaaggacgagctccaggtgctggtgtccaagcagagctctgtcattgacgagctggagaagaagctggtgacagccacggtcaacaactcgctccttcagaagcagcagcatgacctaatggagaccgtcaacagcttgctgaccatgatgtcatcacccaactccaagagctcggttgctatccgtaaagaagagcaaaccaccttcagagactgtgcggaaatcttcaagtcaggactcaccaccagtggcatctacacactgaccttccccaactccacagaggagatcaaggcctactgtgacatggacgtgggtggaggagggtggacagtcatccaacaccgagaagatggcagtgtggacttccagaggacgtggaaagaatacaaagagggcttcgggaaccctctgggagagtactggctgggcaatgagtttgtctcccagctgaccggtcagcaccgctacgtgcttaagatccagctgaaggactgggaaggcaacgaggcgcattcgctgtatgatcacttctacctcgctggtgaagagtccaactacaggattcaccttacaggactcacggggaccgcggccaaaataagtagcatcagccaaccaggaagtgattttagcacaaaggattcggacaatgacaaatgcatctgcaagtgttcccagatgctctcaggaggctggtggtttgacgcatgtggtccttccaacttgaatggacagtactacccacaaaaacagaatacaaataagtttaacggtatcaagtggtactactggaaggggtccggctactcgctcaaggccacaaccatgatgatccggccagcagatttctaaatgcctgcctacactaccagaagaacttgctgcatccaaagattaactccaaggcactgagagacaccagtgcatagcagcccctttccacatcaggaagtgctcctgggggtggggagggtctgtgtgtaccagactgaagcgcatcacttaagcctgcaccgctaaccaaccaaaggcactgcagtctggagaaacacttctgggaaggttgtggctgaggatcagaaggacagcgtgcagactctgtcacaaggaagaatgttccgtgggagttcagcagtaaataactggaaaacagaacacttagatggtgcagataaatcttgggaccacattcctctaagcacggtttctagagtgaatacattcacagctcggctgtcacaatgacaaggccgtgtcctcgcactgtggcagccagtatccagggacttctaagtggtgggcacaggctatcatctggagaagcacacattcattgttttcctcttgggtgcttaacatgttcatttgaaaacaacacatttacctatcttgatggcttagtttttaatggctggctactatttactatatggcaaaaatgcccacatctctggaatanccaccaaataagcgccatgttggtgaatgcggaggctgtactattttgttttcttcctggctggtaaatatgaaggtatttttagtaattaaatataagttattagttgaaagacc

SEQ ID NO: 21 - DNA, 4138 bp, Homo sapiens
cttctgtgctgttccttcttgcctctaacttgtaaacaagacgtactaggacgatgctaatggaaagtcacaaaccgctgggtttttgaaaggatccttgggacctcatgcacatttgtggaaactggatggagagatttggggaagcatggactctttagccagcttagttctctgtggagtcagcttgctcctttctggaactgtggaaggtgccatggacttgatcttgatcaattccctacctcttgtatctgatgctgaaacatctctcacctgcattgcctctgggtggcgcccccatgagcccatcaccataggaagggactttgaagccttaatgaaccagcaccaggatccgctggaagttactcaagatgtgaccagagaatgggctaaaaaagttgtttggaagagagaaaaggctagtaagatcaatggtgcttatttctgtgaagggcgagttcgaggagaggcaatcaggatacgaaccatgaagatgcgtcaacaagcttccttcctaccagctactttaactatgactgtggacaagggagataacgtgaacatatctttcaaaaaggtattgattaaagaagaagatgcagtgatttacaaaaatggttccttcatccattcagtgccccggcatgaagtacctgatattctagaagtacacctgcctcatgctcagccccaggatgctggagtgtactcggccaggtatataggaggaaacctcttcacctcggccttcaccaggctgatagtccggagatgtgaagcccagaagtggggacctgaatgcaaccatctctgtactgcttgtatgaacaatggtgtctgccatgaagatactggagaatgcatttgccctcctgggtttatgggaaggacgtgtgagaaggcttgtgaactgcacacgtttggcagaacttgtaaagaaaggtgcagtggacaagagggatgcaagtcttatgtgttctgtctccctgacccctatgggtgttcctgtgccacaggctggaagggtctgcagtgcaatgaagcatgccaccctggtttttacgggccagattgtaagcttaggtgcagctgcaacaatggggagatgtgtgatcgcttccaaggatgtctctgctctccaggatggcaggggctccagtgtgagagagaaggcataccgaggatgaccccaaagatagtggatttgccagatcatatagaagtaaacagtggtaaatttaatcccatttgcaaagcttctggctggccgctacctactaatgaagaaatgaccctggtgaagccggatgggacagtgctccatccaaaagactttaaccatacggatcatttctcagtagccatattcaccatccaccggatcctcccccctgactcaggagtttgggtctgcagtgtgaacacagtggctgggatggtggaaaagcccttcaacatttctgttaaagttcttccaaagcccctgaatgccccaaacgtgattgacactggacataactttgctgtcatcaacatcagctctgagccttactttggggatggaccaatcaaatccaagaagcttctatacaaacccgttaatcactatgaggcttggcaacatattcaagtgacaaatgagattgttacactcaactatttggaacctcggacagaatatgaactctgtgtgcaactggtccgtcgtggagagggtggggaagggcatcctggacctgtgagacgcttcacaacagcttctatcggactccctcctccaagaggtctaaatctcctgcctaaaagtcagaccactctaaatttgacctggcaaccaatatttccaagctcggaagatgacttttatgttgaagtggagagaaggtctgtgcaaaaaagtgatcagcagaatattaaagttccaggcaacttgacttcggtgctacttaacaacttacatcccagggagcagtacgtggtccgagctagagtcaacaccaaggcccagggggaatggagtgaagatctcactgcttggacccttagtgacattcttcctcctcaaccagaaaacatcaagatttccaacattacacactcctcggctgtgatttcttggacaatattggatggctattctatttcttctattactatccgttacaaggttcaaggcaagaatgaagaccagcacgttgatgtgaagataaagaatgccaccatcattcagtatcagctcaagggcctagagcctgaaacagcataccaggtggacatttttgcagagaacaacatagggtcaagcaacccagccttttctcatgaactggtgaccctcccagaatctcaagcaccagcggacctcggaggggggaagatgctgcttatagccatccttggctctgctggaatgacctgcctgactgtgctgttggcctttctgatcatattgcaattgaagagggcaaatgtgcaaaggagaatggcccaagccttccaaaacgtgagggaagaaccagctgtgcagttcaactcagggactctggccctaaacaggaaggtcaaaaacaacccagatcctacaatttatccagtgcttgactggaatgacatcaaatttcaagatgtgattggggagggcaattttggccaagttcttaaggcgcgcatcaagaaggatgggttacggatggatgctgccatcaaaagaatgaaagaatatgcctccaaagatgatcacagggactttgcaggagaactggaagttctttgtaaacttggacaccatccaaacatcatcaatctcttaggagcatgtgaacatcgaggctacttgtacctggccattgagtacgcgccccatggaaaccttctggacttccttcgcaagagccgtgtgctggagacggacccagcatttgccattgccaatagcaccgcgtccacactgtcctcccagcagctccttcacttcgctgccgacgtggcccggggcatggactacttgagccaaaaacagtttatccacagggatctggctgccagaaacattttagttggtgaaaactatgtggcaaaaatagcagattttggattgtcccgaggtcaagaggtgtacgtgaaaaagacaatgggaaggctcccagtgcgctggatggccatcgagtcactgaattacagtgtgtacacaaccaacagtgatgtatggtcctatggtgtgttactatgggagattgttagcttaggaggcacaccctactgcgggatgacttgtgcagaactctacgagaagctgccccagggctacagactggagaagcccctgaactgtgatgatgaggtgtatgatctaatgagacaatgctggcgggagaagccttatgagaggccatcatttgcccagatattggtgtccttaaacagaatgttagaggagcgaaagacctacgtgaataccacgctttatgagaagtttacttatgcaggaattgactgttctgctgaagaagcggcctaggacagaacatctgtataccctctgtttccctttcactggcatgggagacccttgacaactgctgagaaaacatgcctctgccaaaggatgtgatatataagtgtacatatgtgctggaattctaacaagtcataggttaatatttaagacactgaaaaatctaagtgatataaatcagattcttctctctcattttatccctcacctgtagcatgccagtcccgtttcatttagtcatgtgaccactctgtcttgtgtttccacagcctgcaagttcagtccaggatgctaacatctaaaaatagacttaaatctcattgcttacaagcctaagaatctttagagaagtatacataagtttaggataaaataatgggattttcttttcttttctctggtaatattgacttgtatattttaagaaataacagaaagcctgggtgacatttgggagacatgtgacatttatatattgaattaatatccctacatgtattgcacattgtaaaaagttttagttttgatgagttgtgagtttaccttgtatactgtaggcacactttgcactgatatatcatgagtgaataaatgtcttgcctactcaaaaaaaaaaaa

SEQ ID NO: 22 - DNA, 2578 bp, Homo sapiens
acatttgtggaaactggatggagagatttggggaagcatggactctttagccagcttggttctctgtggagtcagcttgctcctttctggaactgtggaaggtgccatggactctttagccagcttagttctctgtggagtcagcttgctcctttctggaactgtggaaggtgccatggacttgatcttgatcaattccctacctcttgtatctgatgctgaaacatctctcacctgcattgcctctgggtggcgcccccatgagcccatcaccataggaagggactttgaagccttaatgaaccagcaccaggatccgctggaagttactcaagatgtgaccagagaatgggctaaaaaagttgtttggaagagagaaaaggctagtaagatcaatggtgcttatttctgtgaagggcgagttcgaggagaggcaatcaggatacgaaccatgaagatgcgtcaacaagcttccttcctaccagctactttaactatgactgtggacaagggagataacgtgaacatatctttcaaaaaggtattgattaaagaagaagatgcagtgatttacaaaaatggttccttcatccattcagtgccccggcatgaagtacctgatattctagaagtacacctgcctcatgctcagccccaggatgctggagtgtactcggccaggtatataggaggaaacctcttcacctcggccttcaccaggctgatagtccggagatgtgaagcccagaagtggggacctgaatgcaaccatctctgtactgcttgtatgaacaatggtgtctgccatgaagatactggagaatgcatttgccctcctgggtttatgggaaggacgtgtgagaaggcttgtgaactgcacacgtttggcagaacttgtaaagaaaggtgcagtggacaagagggatgcaagtcttatgtgttctgtctccctgacccctatgggtgttcctgtgccacaggctggaagggtctgcagtgcaatgaaggcataccgaggatgaccccaaagatagtggatttgccagatcatatagaagtaaacagtggtaaatttaatcccatttgcaaagcttctggctggccgctacctactaatgaagaaatgaccctggtgaagccggatgggacagtgctccatccaaaagactttaaccatacggatcatttctcagtagccatattcaccatccaccggatcctcccccctgactcaggagtttgggtctgcagtgtgaacacagtggctgggatggtggaaaagcccttcaacatttctgttaaagttcttccaaagcccctgaatgccccaaacgtgattgacactggacataactttgctgtcatcaacatcagctctgagccttactttggggatggaccaatcaaatccaagaagcttctatacaaacccgttaatcactatgaggcttggcaacatattcaagtgacaaatgagattgttacactcaactatttggaacctcggacagaatatgaactctgtgtgcaactggtccgtcgtggagagggtggggaagggcatcctggacctgtgagacgcttcacaacagcttctatcggactccctcctccaagaggtctaaatctcctgcctaaaagtcagaccactctaaatttgacctggcaaccaatatttccaagctcggaagatgacttttatgttgaagtggagagaaggtctgtgcaaaaaagtgatcagcagaatattaaagttccaggcaacttgacttcggtgctacttaacaacttacatcccagggagcagtacgtggtccgagctagagtcaacaccaaggcccagggggaatggagtgaagatctcactgcttggacccttagtgacattcttcctcctcaaccagaaaacatcaagatttccaacattacacactcctcggctgtgatttcttggacaatattggatggctattctatttcttctattactatccgttacaaggttcaaggcaagaatgaagaccagcacgttgatgtgaagataaagaatgccaccatcattcagtatcagctcaagggcctagagcctgaaacagcataccaggtggacatttttgcagagaacaacatagggtcaagcaacccagccttttctcatgaactggtgaccctcccagaatctcaagcaccagcggacctcggaggggggaagatgctgcttatagccatccttggctctgctggaatgacctgcctgactgtgctgttggcctttctgatcatattgcaattgaagagggcaaatgtgcaaaggagaatggcccaagccttccaaaacgtgagggaagaaccagctgtgcagttcaactcagggactctggccctaaacaggaaggtcaaaaacaacccagatcctacaatttatccagtgcttgactggaatgacatcaaatttcaagatgtgattggggagggcaattttggccaagttcttaaggcgcgcatcaagaaggatgggttacggatggatgctgccatcaaaagaatgaaagaatatgcctccaaagatgatcacagg

SEQ ID NO: 23 - DNA, 984 bp, Homo sapiens
atgaagaaacatcatcatcatcatcatggcaaaaacaacccagatcctacaatttatccagtgcttgactggaatgacatcaaatttcaagatgtgattggggagggcaattttggccaagttcttaaggcgcgcatcaagaaggatgggttacggatggatgctgccatcaaaagaatgaaagaatatgcctccaaagatgatcacagggactttgcaggagaactggaagttctttgtaaacttggacaccatccaaacatcatcaatctcttaggagcatgtgaacatcgaggcttcttgtacctggccattgagtacgcgccccatggaaaccttctggacttccttcgcaagagccgtgtgctggagacggacccagcatttgccattgccaatagcaccgcgtccacactgtcctcccagcagctccttcacttcgctgccgacgtggcccggggcatggactacttgagccaaaaacagtttatccacagggatctggctgccagaaacattttagttggtgaaaactatgtggcaaaaatagcagattttggattgtcccgaggtcaagaggtgtatgtgaaaaagacaatgggaaggctcccagtgcgctggatggccatcgagtcactgaattacagtgtgtacacaaccaacagtgatgtatggtcctatggtgtgttactatgggagattgttagcttaggaggcacaccctactgcggaatgacttgtgcagaactcttcgagaagctgccccagggctacagactggagaagcccctgaactgtgatgatgaggtgtatgatctaatgagacaatgctggcgggagaagccttatgagaggccatcatttgcccagatattggtgtccttaaacagaatgttagaggagcgaaagacctacgtgaataccacgctttatgagaagtttacttatgcaggaattgactgtgctgctgaagaagcggcctag

SEQ ID NO: 24 - DNA, 4676 bp, Mus musculus
ccacgcgtccgagcaggagccggagcaggagcagaagataagccttggatgaagggcaagatggatagggctcgctctgccccaagccctgctgataccaagtgcctttaagatacagcctttcccatcctaatctgcaaaggaaacaggaaaaaggaacttaaccctccctgtgctcagacagaaatgagactgttaccgcctgcttctgtggtgtttctccttgccgccaacttgtaaacaagagcgagtggaccatgcgagcgggaagtcgcaaagttgtgagttgttgaaagcttcccagggactcatgctcatctgtggacgctggatggggagatctggggaagtatggactctttagccggcttagttctctgtggagtcagcttgctcctttatggagtagtagaaggtgccatggacctgatcttgatcaattccctacctcttgtgtctgatgccgaaacatccctcacctgcattgcctctgggtggcacccccatgagcccatcaccataggaagggactttgaagccttaatgaaccagcaccaagatccactggaggttactcaagatgtgaccagagaatgggcgaaaaaagttgtttggaagagagaaaaggccagtaagattaatggtgcttatttctgtgaaggtcgagttcgaggacaggctataaggatacggaccatgaagatgcgtcaacaagcgtccttcctacctgctactttaactatgaccgtggacaggggagataatgtgaacatatctttcaaaaaggtgttaattaaagaagaagatgcagtgatttacaaaaatggctcccttcatccactcagtgcccccggcatgaagtaccttgatattttagaagttcacttgccgcatgctcagccccaggatgctggtgtgtactcggccaggtacataggaggaaacctgttcacctcagccttcaccaggctgattgttcggagatgtgaagctcagaagtgggggcccgactgtagccgtccttgtactacttgcaagaacaatggagtctgccatgaagataccggggaatgcatttgccctcctgggtttatggggagaacatgtgagaaagcttgtgagccgcacacatttggcaggacctgtaaagaaaggtgtagtggaccagaaggatgcaagtcttatgtgttctgtctcccagacccttacgggtgttcctgtgccacaggctggagggggttgcagtgcaatgaagcatgcccatctggttactacggaccagactgtaagctcaggtgccactgtaccaatgaagagatatgtgatcggttccaaggatgcctctgctctcaaggatggcaagggctgcagtgtgagaaagaaggcaggccaaggatgactccacagatagaggatttgccagatcacattgaagtaaacagtggaaaatttaaccccatctgcaaagcctctgggtggccactacctactagtgaagaaatgaccctagtgaagccagatgggacagtgctccaaccaaatgacttcaactatacagatcgtttctcagtggccatattcactgtcaaccgagtcttacctcctgactcaggagtctgggtctgcagtgtgaacacagtggctgggatggtggaaaagcctttcaacatttccgtcaaagttcttccagagcccctgcacgccccaaatgtgattgacactggacataactttgctatcatcaatatcagctctgagccttactttggggatggacccatcaaatccaagaagcttttctataaacctgtcaatcaggcctggaaatacattgaagtgacgaatgagattttcactctcaactacttggagccgcggactgactacgagctgtgtgtgcagctggcccgtcctggagagggtggagaagggcatcctgggcctgtgagacgatttacaacagcgtctatcggactccctcctccaagaggtctcagtctcctgccaaaaagccagacagctctaaatttgacttggcaaccgatatttacaaactcagaagatgaattttatgtggaagtcgagaggcgatccctgcaaacaacaagtgatcagcagaacatcaaagtgcctgggaacctgacctcggtgctactgagcaacttagtccccagggagcagtacacagtccgagctagagtcaacaccaaggcgcagggggagtggagtgaagaactcagggcctggacccttagtgacattctccctcctcaaccagaaaacatcaagatctccaacatcactgactccacagctatggtttcttggacaatagtggatggctattcgatttcttccatcatcatccggtataaggttcagggcaaaaatgaagaccagcacattgatgtgaagatcaagaatgctaccgttactcagtaccagctcaagggcctagagccagagactacataccatgtggatatttttgctgagaacaacataggatcaagcaacccagccttttctcatgaactgaggacgcttccacattccccagcctctgcagacctcggaggggggaaagatgctactcatagccatccttgggtcggctggaatgactttgcatcaccgtgcttgttggcgtttctgattatgttgcaactgaagagagcaaatgtccaaaggagaatggctcaggcattccagaacgtgagagaagaaccagctgtgcagtttaactcaggaactctggcccttaacaggaaggccaaaaacaatccggatcccacaatttatcctgtgcttgactggaatgacatcaagtttcaagacgtgatcggagagggcaactttggccaggttctgaaggcacgcatcaagaaggatgggttacggatggatgccgccatcaagaggatgaaagagtatgcctccaaagatgatcacagggacttcgcaggagaactggaggttctttgtaaacttggacaccatccaaacatcatcaatctcttgggagcatgtgaacaccgaggctatttgtacctagctattgagtatgccccgcatggaaacctcctggacttcctgggtaagagcagagtgctagagacagaccctgctttttgccatcgccaacagtacagttccacactgtcctcccaacagcttcttcattttgctgcagatgtggcccgggggatggactacttgagccagaaacagtttatccacagggacctggctgccagaaacattttagttggtgaaaactacatagccaaaatagcagattttggattgtcacgaggtcaagaagtgtatgtgaaaaagacaatgggaaggctcccagtgcgttggatggcaatcgaatcactgaactatagtgtctatacaaccaacagtgatgtctggtcctatggtgtattgctctgggagattgttagcttaggaggcaccccctactgcggcatgacgtgcgcggagctctatgagaagctaccccagggctacaggctggagaagcccctgaactgtgatgatgaggtgtatgatctaatgagacagtgctggagggagaagccttatgagagaccatcatttgcccagatattggtgtccttaaacaggatgctggaagaacggaagacatacgtgaacaccacactgtatgagaagtttacctatgcaggaattgactgccctgcggaagaagcagcctagagcagaactcttcatgtacaacggccatttctcctcactggcgcgagacctttgtacacctgtaccaagcaagccacccactgccaagagatgtgatatataagtttatatattgtgctgtgtttgggaccctcctcatacagttcgtgcggatctgcagtgtgttctgactctaatgtgactgtatatactgctcggagtaagaatgtgctaagatcagaatgcctgtccgtggtttcatctaatatattttcctaaaagcatagattgcacaggaaggtatgagtacaaatactgtaatgcataacttgttattgtcctagatgtgtttgatattttcgctttacaactgaatgctataaaagtgttttgctgtgtacacataagatactgttcgttaaaataagcattcccttgacagcacaggaagaaaagcgagggaaatgtatggattatattaaatgtgggttactacacaagaggccgaacattccaagtagcagaagagagggtctctcaactctgctcctcacctgcagaagccagtttgtttggccatgtgacaattgtcctgtgtttttatagcacccaaatcattctaaaatatgaacatctaaaaactttgctaggagactaagaacctttggagagatagatataagtacggtcaaaaaacaaaactgcgggacttacatttattttctatagtaatctgttgtacattttaaggaggtaaactaggatttaggagtgatgtgtgacatttctgccatggagttaccatccccacatgtatcacatactgcatattcccacatgtatcacacatgtattgtaaaattttgtagttttgatcacttgtgaatttactgttgatgtggtagccacctgctgcaatggttcctcttgtaggtgaataaatgtcttgtctacccacaaaaaaaaaa

SEQ ID NO: 25 - DNA, 2135 bp, Rattus norvegicus
agcccctgcatgccccaaatgttattgacactggacacaactttgctatcatcaacatcagctctgagccttactttggggatggaccgatcaaatccaagaagctcttctataaacctgtcaatcaggcttggaaatacattcaagtgatgaatgagattgtcacactcaactacctggagcctcggactgactacgagctgtgtgtacagctggtccgtcctggagagggtggagaaggacatcctggacctgtgagaagattcacaacagcgtctatcggactccctcctccaagaggtctcagtctcctacccaaaagccagacagctctgaatttgacttggcaaccgatatttacaagctcagaagatgaattttatgtggaagttgagaggtggtcccagcaaacaagaagtgatcagcagaacatcaaagtgcctgggaacctgacttccgtgctgctgaacaacttactccccagggagcagtacagcgtccgagctagagtcaacaccaaggcccagggggagtggagtgaagaactcagggcctggacccttagtgacaaaaacatcaagatcaccaacatcactgattacacagctctggtttcttggacaatcgtggacggctattcgatttcttccatcatcatccggtataaggttcagggcaaaaatgaagaccagcacattgacgtgaagatcaagaatgccaccatcactcaataccagctcaagggcctagagccagagactacataccatgtggatatttttgctgagaacaacataggatcaagcaacccagccttttcccaagaaattaggacacttccagcccctaaagaccttggagggggaaagatgctacttatagccattcttgggtcggctggaatgacttgcatcaccgtgctattggcgtttctgattatgttgcaactgaagagagcaaatgtccaaagaagaatggcccaggccttccagaacgtgagagaagaaccagctgttcagttcaactcaggaactctggccctaaacaggaaggccaaaaacaatccggatcccacaatttatcctgtgcttgactggaatgacatcaagttccaagatgtgattggagagggcaactttggccaggttctgaaggcgcgcatcaagaaggatgggttacggatggacgctgccatcaagaggatgaaaggtttggaggacagcatttgctggggtggggagacaccgcttcctgttgaaatcttccgtttgtggccatatattcttcaaaccagatgtgaagaagcaacattacaactcttggcctttcttccagaatatgcctccaaagatgatcacagggactttgcaggagaactggaggttctttgtaaacttggacaccatccgaacatcattaatctcttgggagcatgtgaacacagaggctacttatacctggctattgagtatgccccacatggaaacctcctggactttctgcgtaagagccgagtgctagagacagaccctgcctttgccatcgccaacagcacggcttccacactgtcctcccagcagcttcttcattttgctgcagatgtggcccgggggatggactacttgagccaaaaacagtttatccacagggacctggctgccagaaacattttagttggcgaaaactacatagccaaaatagcagattttggattgtcacgaggtcaagaagtgtatgtgaaaaagacaatgggaaggctcccagtgcgctggatggcaattgagtctctgaactatagtgtctatacaaccaacagtgatgtatggtcctatggtgtattgctctgggagatcgttagcttaggaggcactccatactgcggcatgacatgtgcagaactctatgagaagctgccccagggctacagattggagaagcccctgaactgtgatgatgaggtgtatgatctaatgagacaatgctggagggagaagccttatgagagaccatcatttgcccagatattggtgtccttaaacagaatgctggaagaacgaaagacatacgtgaacaccacactttatgagaagtttacctacgcaggaattgactgttctgctgaagaagcagcctag

SEQ ID NO: 26 - DNA, 1553 bp, Homo sapiens
  CDS (27)..(1514)
ctgagatcaccggtaggagggccaacatgtggcagattgttttctttactctgagctgtgatcttgtcttggccgcagcctataacaactttcggaagagcatggacagcataggaaagaagcaatatcaggtccagcatgggtcctgcagctacactttcctcctgccagagatggacaactgccgctcttcctccagcccctacgtgtccaatgctgtgcagagggacgcgccgctcgaatacgatgactcggtgcagaggctgcaagtgctggagaacatcatggaaaacaacactcagtggctaatgaagcttgagaattatatccaggacaacatgaagaaagaaatggtagagatacagcagaatgcagtacagaaccagacggctgtgatgatagaaatagggacaaacctgttgaaccaaacagctgagcaaacgcggaagttaactgatgtggaagcccaagtattaaatcagaccacgagacttgaacttcagctcttggaacactccctctcgacaaacaaattggaaaaacagattttggaccagaccagtgaaataaacaaattgcaagataagaacagtttcctagaaaagaaggtgctagctatggaagacaagcacatcatccaactacagtcaataaaagaagagaaagatcagctacaggtgttagtatccaagcaaaattccatcattgaagaactagaaaaaaaaatagtgactgccacggtgaataattcagttcttcaaaagcagcaacatgatctcatggagacagttaataacttactgactatgatgtccacatcaaactcagctaaggaccccactgttgctaaagaagaacaaatcagcttcagagactgtgctgaagtattcaaatcaggacacaccacaaatggcatctacacgttaacattccctaattctacagaagagatcaaggcctactgtgacatggaagctggaggaggcgggtggacaattattcagcgacgtgaggatggcagcgttgattttcagaggacttggaaagaatataaagtgggatttggtaacccttcaggagaatattggctgggaaatgagtttgtttcgcaactgactaatcagcaacgctatgtgcttaaaatacaccttaaagactgggaagggaatgaggcttactcattgtatgaacatttctatctctcaagtgaagaactcaattataggattcaccttaaaggacttacagggacagccggcaaaataagcagcatcagccaaccaggaaatgattttagcacaaaggatggagacaacgacaaatgtatttgcaaatgttcacaaatgctaacaggaggctggtggtttgatgcatgtggtccttccaacttgaacggaatgtactatccacagaggcagaacacaaataagttcaacggcattaaatggtactactggaaaggctcaggctattcgctcaaggccacaaccatgatgatccgaccagcagatttctaaacatcccagtccacctgaggaactgtctcgaattcg

SEQ ID NO: 27 - protein, 496 aa, Homo sapiens
MWQIVFFTLSCDLVLAAAYNNFRKSMDSIGKKQYQVQHGSCSYTFLLPEMDNCRSSSSPYVSNAVQRDAPLEYDDSVQRLQVLENIMENNTQWLMKLENYIQDNMKKEMVEIQQNAVQNQTAVMIEIGTNLLNQTAEQTRKLTDVEAQVLNQTTRLELQLLEHSLSTNKLEKQILDQTSEINKLQDKNSFLEKKVLAMEDKHIIQLQSIKEEKDQLQVLVSKQNSIIEELEKKIVTATVNNSVLQKQQHDLMETVNNLLTMMSTSNSAKDPTVAKEEQISFRDCAEVFKSGHTTNGIYTLTFPNSTEEIKAYCDMEAGGGGWTIIQRREDGSVDFQRTWKEYKVGFGNPSGEYWLGNEFVSQLTNQQRYVLKIHLKDWEGNEAYSLYEHFYLSSEELNYRIHLKGLTGTAGKISSISQPGNDFSTKDGDNDKCICKCSQMLTGGWWFDACGPSNLNGMYYPQRQNTNKFNGIKWYYWKGSGYSLKATTMMIRPADF

SEQ ID NO: 28 - DNA, 1535 bp, Mus musculus
  CDS (2)..(1492)
catgggatggcagatcattttcctaacttttggctgggatcttgtcttggcctcagcctacagtaactttaggaagagcgtggacagcacaggcagaaggcagtaccaggtccagaacggaccctgcagctacacgttcctgctgccggagaccgacagctgccgatcttcctccagcccctacatgtccaatgccgtgcagagggatgcacccctcgactacgacgactcagtgcaaaggctgcaggtgctggagaacattctagagaacaacacacagtggctgatgaagctggagaattacattcaggacaacatgaagaaggagatggtggagatccaacagaatgtggtgcagaaccagacagctgtgatgatagagattggaaccagcttgctgaaccagacagcagcacaaactcggaaactgactgatgtggaagcccaagtactaaaccagacgacaagactcgagctgcagcttctccaacattctatttctaccaacaaattggaaaagcagattttggatcagaccagtgaaataaacaagctacaaaataagaacagcttcctagaacagaaagttctggacatggagggcaagcacagcgagcagctacagtccatgaaggagcagaaggacgagctccaggtgctggtgtccaagcagagctctgtcattgacgagctggagaagaagctggtgacagccacggtcaacaactcgctccttcagaagcagcagcatgacctaatggagaccgtcaacagcttgctgaccatgatgtcatcacccaactccaagagctcggttgctatccgtaaagaagagcaaaccaccttcagagactgtgcggaaatcttcaagtcaggactcaccaccagtggcatctacacactgaccttccccaactccacagaggagatcaaggcctactgtgacatggacgtgggtggaggagggtggacagtcatccaacaccgagaagatggcagtgtggacttccagaggacgtggaaagaatacaaagagggcttcgggagccctctgggagagtactggctgggcaatgagtttgtctcccagctgaccggtcagcaccgctacgtgcttaagatccagctgaaggactgggaaggcaacgaggcgcattcgctgtatgatcacttctacctcgctggtgaagagtccaactacaggattcaccttacaggactcacggggaccgcgggcaaaataagtagcatcagccaaccaggaagtgattttagcacaaaggattcggacaatgacaaatgcatctgcaagtgttcccagatgctctcaggaggctggtggtttgacgcatgtggtccttccaacttgaatggacagtactacccacaaaaacagaatacaaataagtttaacggtatcaagtggtactactggaaggggtccggctactcgctcaaggccacaaccatgatgatccggccagcagatttctaaatgcctgcctacactaccagaagaacttgctgcatccaag

SEQ ID NO: 29 - protein, 497 aa, Mus musculus
MGWQIIFLTFGWDLVLASAYSNFRKSVDSTGRRQYQVQNGPCSYTFLLPETDSCRSSSSPYMSNAVQRDAPLDYDDSVQRLQVLENILENNTQWLMKLENYIQDNMKKEMVEIQQNVVQNQTAVMIEIGTSLLNQTAAQTRKLTDVEAQVLNQTTRLELQLLQHSISTNKLEKQILDQTSEINKLQNKNSFLEQKVLDMEGKHSEQLQSMKEQKDELQVLVSKQSSVIDELEKKLVTATVNNSLLQKQQHDLMETVNSLLTMMSSPNSKSSVAIRKEEQTTFRDCAEIFKSGLTTSGIYTLTFPNSTEEIKAYCDMDVGGGGWTVIQHREDGSVDFQRTWKEYKEGFGSPLGEYWLGNEFVSQLTGQHRYVLKIQLKDWEGNEAHSLYDHFYLAGEESNYRIHLTGLTGTAGKISSISQPGSDFSTKDSDNDKCICKCSQMLSGGWWFDACGPSNLNGQYYPQKQNTNKFNGIKWYYWKGSGYSLKATTMMIRPADF

SEQ ID NO: 30 - DNA, 1187 bp, Homo sapiens
  CDS (29)..(1183)
ctgagatcaccggcgaaggagggccaccatgtacaggatgcaactcctgtcttgcattgcactaagtcttgcacttgtcacgaattcggtgtatctctcagagtgcaagactgggaatggaaagaactacagagggacgatgtccaaaacaaaaaatggcatcacctgtcaaaaatggagttccacttctccccacagacctagattctcacctgctacacacccctcagagggactggaggagaactactgcaggaatccagacaacgatccgcaggggccctggtgctatactactgatccagaaaagagatatgactactgcgacattcttgagtgtgaagaggaatgtatgcattgcagtggagaaaactatgacggcaaaatttccaagaccatgtctggactggaatgccaggcctgggactctcagagcccacacgctcatggatacattccttccaaatttccaaacaagaacctgaagaagaattactgtcgtaaccccgatagggagctgcggccttggtctttcaccaccgaccccaacaagcgctgggaactttgtgacatcccccgctgcacaacacctccaccatcttctggtcccacctaccagtgtctgaagggaacaggtgaaaactatcgcgggaatgtggctgttaccgtgtccgggcacacctgtcagcactggagtgcacagacccctcacacacataacaggacaccagaaaacttcccctgcaaaaatttggatgaaaactactgccgcaatcctgacggaaaaagggccccatggtgccatacaaccaacagccaagtgcggtgggactactgtaagataccgtcctgtgactcctccccagtatccacggaacaattggctcccacagcaccacctgagctaacccctgtggtccaggactgctaccatggtgatggacagagctaccgaggcacatcctccaccaccaccacaggaaagaagtgtcagtcttggtcatctatgacaccacaccggcaccagaagaccccagaaaactacccaaatgctggcctgacaatgaactactgcaggaatccagatgccgataaaggcccctggtgttttaccacagaccccagcgtcaggtgggagtactgcaacctgaaaaaatgctcaggaacagaagcgagtgttgtatagg

SEQ ID NO: 31 - protein, 385 aa, Homo sapiens
MYRMQLLSCIALSLALVTNSVYLSECKTGNGKNYRGTMSKTKNGITCQKWSSTSPHRPRFSPATHPSEGLEENYCRNPDNDPQGPWCYTTDPEKRYDYCDILECEEECMHCSGENYDGKISKTMSGLECQAWDSQSPHAHGYIPSKFPNKNLKKNYCRNPDRELRPWSFTTDPNKRWELCDIPRCTTPPPSSGPTYQCLKGTGENYRGNVAVTVSGHTCQHWSAQTPHTHNRTPENFPCKNLDENYCRNPDGKRAPWCHTTNSQVRWDYCKIPSCDSSPVSTEQLAPTAPPELTPVVQDCYHGDGQSYRGTSSTTTTGKKCQSWSSMTPHRHQKTPENYPNAGLTMNYCRNPDADKGPWCFTTDPSVRWEYCNLKKCSGTEASVV

SEQ ID NO: 32 - DNA, 1180 bp, Mus musculus
  CDS (29)..(1177)
ctgagatcaccggcgaaggagggccaccatgtacaggatgcaactcctgtcttgcattgcactaagtcttgcacttgtcacgaattcggtgtatctgtcagaatgtaagaccggcatcggcaacggctacagaggaaccatgtccaggacaaagagtggtgttgcctgtcaaaagtggggtgccacgttcccccacgtacccaactactctcccagtacacatcccaatgagggactagaagagaactactgtaggaacccagacaatgatgaacaagggccttggtgctacactacagatccggacaagagatatgactactgcaacattcctgaatgtgaagaggaatgcatgtactgcagtggagaaaagtatgagggcaaaatctccaagaccatgtctggacttgactgccaggcctgggattctcagagcccacatgctcatggatacatccctgccaaatttccaagcaagaacctgaagatgaattattgccgcaaccctgacggggagccaaggccctggtgcttcacaacagaccccaccaaacgctgggaatactgtgacatcccccgctgcacaacacccccgcccccacccagcccaacctaccaatgtctgaaaggaagaggtgaaaattaccgagggaccgtgtctgtcaccgtgtctgggaaaacctgtcagcgctggagtgagcaaacccctcataggcacaacaggacaccagaaaatttcccctgcaaaaatctggaagagaactactgccggaacccagatggagaaactgctccctggtgctataccactgacagccagctgaggtgggagtactgtgagattccatcctgcgagtcctcagcatcaccagaccagtcagattcctcagttccaccagaggagcaaacacctgtggtccaggaatgctaccagagcgatgggcagagctatcggggtacatcgtccactaccatcacagggaagaagtgccagtcctgggcagctatgtttccacacaggcattcgaagaccccagagaacttcccagatgctggcttggagatgaactactgcaggaacccggatggtgacaagggcccttggtgctacaccactgacccgagcgtcaggtgggaatactgcaacctgaagcggtgctcagagacaggagggagttag

SEQ ID NO: 33 - protein, 383 aa, Mus musculus
MYRMQLLSCIALSLALVTNSVYLSECKTGIGNGYRGTMSRTKSGVACQKWGATFPHVPNYSPSTHPNEGLEENYCRNPDNDEQGPWCYTTDPDKRYDYCNIPECEEECMYCSGEKYEGKISKTMSGLDCQAWDSQSPHAHGYIPAKFPSKNLKMNYCRNPDGEPRPWCFTTDPTKRWEYCDIPRCTTPPPPPSPTYQCLKGRGENYRGTVSVTVSGKTCQRWSEQTPHRHNRTPENFPCKNLEENYCRNPDGETAPWCYTTDSQLRWEYCEIPSCESSASPDQSDSSVPPEEQTPVVQECYQSDGQSYRGTSSTTITGKKCQSWAAMFPHRHSKTPENFPDAGLEMNYCRNPDGDKGPWCYTTDPSVRWEYCNLKRCSETGGS

SEQ ID NO: 34 - DNA, 1460 bp, Homo sapiens
  CDS (27)..(1421)
ctgagatcaccggtaggagggccatcatgatttattccaatgtgataggaactgtaacctctggaaaaaggaaggtttatcttttgtccttgctgctcattggcttctgggactgcgtgacctgtcacgggagccctgtggacatctgcacagccaagccgcgggacattcccatgaatcccatgtgcatttaccgctccccggagaagaaggcaactgaggatgagggctcagaacagaagatcccggaggccaccaaccggcgtgtctgggaactgtccaaggccaattcccgctttgctaccactttctatcagcacctggcagattccaagaatgacaatgataacattttcctgtcacccctgagtatctccacggcttttgctatgaccaagcttggtgcctgtaatgacaccctccagcaactgatggaggtatttaagtttgacaccatatctgagaaaacatctgatcagatccacttcttctttgccaaactgaactgccgactctatcgaaaagccaacaaatcctccaagttagtatcagccaatcgcctttttggagacaaatcccttaccttcaatgagacctaccaggacatcagtgagttggtatatggagccaagctccagcccctggacttcaaggaaaatgcagagcaatccagagcggccatcaacaaatgggtgtccaataagaccgaaggccgaatcaccgatgtcattccctcggaagccatcaatgagctcactgttctggtgctggttaacaccatttacttcaagggcctgtggaagtcaaagttcagccctgagaacacaaggaaggaactgttctacaaggctgatggagagtcgtgttcagcatctatgatgtaccaggaaggcaagttccgttatcggcgcgtggctgaaggcacccaggtgcttgagttgcccttcaaaggtgatgacatcaccatggtcctcatcttgcccaagcctgagaagagcctggccaaggtagagaaggaactcaccccagaggtgctgcaagagtggctggatgaattggaggagatgatgctggtggtccacatgccccgcttccgcattgaggacggcttcagtttgaaggagcagctgcaagacatgggccttgtcgatctgttcagccctgaaaagtccaaactcccaggtattgttgcagaaggccgagatgacctctatgtctcagatgcattccataaggcatttcttgaggtaaatgaagaaggcagtgaagcagctgcaagtaccgctgttgtgattgctggccgttcgctaaaccccaacagggtgactttcaaggccaacaggcctttcctggtttttataagagaagttcctctgaacactattatcttcatgggcagagtagccaacccttgtgttaagtaaaatgttcttattctttgcacctcttcctatttttgg

SEQ ID NO: 35 - protein, 465 aa, Homo sapiens
MIYSNVIGTVTSGKRKVYLLSLLLIGFWDCVTCHGSPVDICTAKPRDIPMNPMCIYRSPEKKATEDEGSEQKIPEATNRRVWELSKANSRFATTFYQHLADSKNDNDNIFLSPLSISTAFAMTKLGACNDTLQQLMEVFKFDTISEKTSDQIHFFFAKLNCRLYRKANKSSKLVSANRLFGDKSLTFNETYQDISELVYGAKLQPLDFKENAEQSRAAINKWVSNKTEGRITDVIPSEAINELTVLVLVNTIYFKGLWKSKFSPENTRKELFYKADGESCSASMMYQEGKFRYRRVAEGTQVLELPFKGDDITMVLILPKPEKSLAKVEKELTPEVLQEWLDELEEMMLVVHMPRFRIEDGFSLKEQLQDMGLVDLFSPEKSKLPGIVAEGRDDLYVSDAFHKAFLEVNEEGSEAAASTAVVIAGRSLNPNRVTFKANRPFLVFIREVPLNTIIFMGRVANPCVK

SEQ ID NO: 36 - DNA, 1456 bp, Mus musculus
  CDS (27)..(1424)
ctgagatcaccggtaggagggccatcatgatttattcccctgggtcaggaagtggggctgctggtgagaggaagctttgtctcctctctctgctcctcatcggtgccttgggctgtgctatctgtcacgggaaccctgtggacgacatctgcatagcgaagccccgagacatccccgtgaatcccttgtgcatttaccgctcccctgggaagaaggccaccgaggaggatggctcagagcagaaggttccagaagccaccaaccggcgggtctgggaactgtccaaggccaattcgcgatttgccactaacttctaccagcacctggcagactccaagaatgacaacgacaacattttcctgtcacccttgagcatctccactgcttttgctatgaccaagctgggtgcctgtaacgacactctcaagcagctgatggaggtttttaaatttgataccatctccgagaagacatccgaccagatccacttcttctttgccaaactgaactgccgactctatcgaaaagccaacaagtcctctgacttggtatcagccaaccgcctttttggagacaaatccctcaccttcaacgagagctatcaagacgttagtgaggttgtctatggagccaagctccagcccttggacttcaaggagaatccggagcaatccagagtgaccatcaacaactgggtagctaataagactgaaggccgcatcaaagatgtcatcccacagggcgccattaacgagctcacggccctggtgctggttaacaccatttacttcaagggcctgtggaagtcaaagttcagccctgagaacacaaggaaggaaccgttctataaggtcgatgggcagtcatgcccagtgcctatgatgtaccaggaaggcaaattcaaataccggcgcgtggcagagggcacccaggtgctagagctgcccttcaagggggatgacatcaccatggtgctcatcctgcccaagcctgagaagagcctggccaaggtggagcaggagctcaccccagagctgctgcaggagtggctggatgagctgtcagagacgatgcttgtggtccacatgccccgcttccgcaccgaggatggcttcagtctgaaggagcagctgcaagacatgggcctcattgatctcttcagccctgaaaagtcccaactcccagggatcgttgctggaggcagggacgacctctatgtctccgacgcattccacaaagcatttcttgaggtaaatgaggaaggcagtgaagcagcagcgagtacttctgtcgtgattactggccggtcactgaaccccaatagggtgaccttcaaggccaacaggcccttcctggttcttataagggaagttgcactgaacactattatattcatggggagagtggctaatccttgtgtgaactaaaataatctttgcaccttttcctactttgg

SEQ ID NO: 37 - protein, 466 aa, Mus musculus
MIYSPGSGSGAAGERKLCLLSLLLIGALGCAICHGNPVDDICIAKPRDIPVNPLCIYRSPGKKATEEDGSEQKVPEATNRRVWELSKANSRFATNFYQHLADSKNDNDNIFLSPLSISTAFAMTKLGACNDTLKQLMEVFKFDTISEKTSDQIHFFFAKLNCRLYRKANKSSDLVSANRLFGDKSLTFNESYQDVSEVVYGAKLQPLDFKENPEQSRVTINNWVANKTEGRIKDVIPQGAINELTALVLVNTIYFKGLWKSKFSPENTRKEPFYKVDGQSCPVPMMYQEGKFKYRRVAEGTQVLELPFKGDDITMVLILPKPEKSLAKVEQELTPELLQEWLDELSETMLVVHMPRFRTEDGFSLKEQLQDMGLIDLFSPEKSQLPGIVAGGRDDLYVSDAFHKAFLEVNEEGSEAAASTSVVITGRSLNPNRVTFKANRPFLVLIREVALNTIIFMGRVANPCVN

SEQ ID NO: 38 - DNA, 492 bp, Homo sapiens
  CDS (27)..(488)
ctgagatcaccggtaggagggccatcatgagagccctgctggcgcgcctgcttctctgcgtcctggtcgtgagcgactccaaaggcagcaatgaacttcatcaagttccatcgaactgtgactgtctaaatggaggaacatgtgtgtccaacaagtacttctccaacattcactggtgcaactgcccaaagaaattcggagggcagcactgtgaaatagataagtcaaaaacctgctatgaggggaatggtcacttttaccgaggaaaggccagcactgacaccatgggccggccctgcctgccctggaactctgccactgtccttcagcaaacgtaccatgcccacagatctgatgctcttcagctgggcctggggaaacataattactgcaggaacccagacaaccggaggcgaccctggtgctatgtgcaggtgggcctaaagctgcttgtccaagagtgcatggtgcatgactgcgcagatggatgag

SEQ ID NO: 39 - protein, 154 aa, Homo sapiens
MRALLARLLLCVLVVSDSKGSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKLLVQECMVHDCADG

SEQ ID NO: 40 - DNA, 495 bp, Mus musculus
  CDS (27)..(491)
ctgagatcaccggtaggagggccatcatgaaagtctggctggcgagcctgttcctctgcgccttggtggtgaaaaactctgaaggtggcagtgtacttggagctcctgatgaatcaaactgtggctgtcagaacggaggtgtatgcgtgtcctacaagtacttctccagaattcgccgatgcagctgcccaaggaaattccagggggagcactgtgagatagatgcatcaaaaacctgctatcatggaaatggtgactcttaccgaggaaaggccaacactgataccaaaggtcggccctgcctggcctggaatgcgcctgctgtccttcagaaaccctacaatgcccacagacctgatgctattagcctaggcctggggaaacacaattactgcaggaaccctgacaaccagaagcgaccctggtgctatgtgcagattggcctaaggcagtttgtccaagaatgcatggtgcatgactgctctcttagctgag

SEQ ID NO: 41 - protein, 155 aa, Mus musculus
MKVWLASLFLCALVVKNSEGGSVLGAPDESNCGCQNGGVCVSYKYFSRIRRCSCPRKFQGEHCEIDASKTCYHGNGDSYRGKANTDTKGRPCLAWNAPAVLQKPYNAHRPDAISLGLGKHNYCRNPDNQKRPWCYVQIGLRQFVQECMVHDCSLS

SEQ ID NO: 42 - DNA, 1395 bp, Homo sapiens
  CDS (2)..(1255)
catggctctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaataatgtctctgtgagactcgagaactttcatttttttccaggctggttcggatttggggtggattttggttg

SEQ ID NO: 43 - protein, 418 aa, Homo sapiens
MALLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDKKRKEEEEAEDKEDDEDKDEDEEDEEDKEEDEEEDVPGQAKDEL

SEQ ID NO: 44 - DNA, 1300 bp, Mus musculus
  CDS (2)..(1252)
catggctctcctttcggtgccgctcctgcttggcctcctcggcctggccgccgcagaccctgccatctatttcaaagagcagttcttggacggagatgcctggaccaaccgctgggtcgaatccaaacataagtccgattttggcaaatttgtcctcagttctggcaaattttacggggacctggagaaggataaagggctgcagacaagccaagatgcccgattttacgcactgtccgccaaattcgaacccttcagcaataagggccagacactggtggtacagttcacggtgaagcatgagcagaatatcgactgtgggggcggctacgtgaagctgtttccgagtggcttggaccagaaggacatgcatggagactcagaatataacatcatgtttggtccggacatctgcggtcctggcaccaagaaggttcatgtcatctttaactacaagggcaagaatgtgctgatcaacaaggatatccggtgtaaggatgatgaattcacacacctatacacactgattgtgcggccagacaacacctatgaggtgaaaattgacaacagccaggtggagtcaggctccttggaggatgattgggactttctgccacccaagaagataaaggaccctgatgctgccaagccggaagactgggatgaacgagccaagatcgatgaccccacagattccaagcctgaggactgggacaagccagagcacatccctgaccctgatgctaagaagcctgaggactgggatgaagagatggatggagagtgggaaccaccagtgattcaaaatcctgaatacaagggcgagtggaaaccacgtcaaattgacaacccagattacaagggtacctggatacacccagaaattgacaaccctgaatactcccccgatgcaaatatctatgcctatgatagttttgctgtactgggcctagatctctggcaggtcaagtctgggacaatctttgacaatttcctcatcaccaatgatgaggcctatgcagaggagtttggcaatgagacgtggggtgttaccaaggctgcagagaagcagatgaaggacaagcaggatgaggagcagaggcttaaggaagaagaagaggacaagaagcgtaaagaggaagaagaagctgaggataaagaggatgatgatgacagagatgaagatgaggacgaagaagatgagaaggaggaagatgaggaagaatcccctggccaagccaaggatgagctgtagaggccacaccacctgccttcagggctggactgaggcctgaacacg

SEQ ID NO: 45 - protein, 417 aa, Mus musculus
MALLSVPLLLGLLGLAAADPAIYFKEQFLDGDAWTNRWVESKHKSDFGKFVLSSGKFYGDLEKDKGLQTSQDARFYALSAKFEPFSNKGQTLVVQFTVKHEQNIDCGGGYVKLFPSGLDQKDMHGDSEYNIMFGPDICGPGTKKVHVIFNYKGKNVLINKDIRCKDDEFTHLYTLIVRPDNTYEVKIDNSQVESGSLEDDWDFLPPKKIKDPDAAKPEDWDERAKIDDPTDSKPEDWDKPEHIPDPDAKKPEDWDEEMDGEWEPPVIQNPEYKGEWKPRQIDNPDYKGTWIHPEIDNPEYSPDANIYAYDSFAVLGLDLWQVKSGTIFDNFLITNDEAYAEEFGNETWGVTKAAEKQMKDKQDEEQRLKEEEEDKKRKEEEEAEDKEDDDDRDEDEDEEDEKEEDEEESPGQAKDEL

SEQ ID NO: 46 - DNA, 620 bp, Homo sapiens
  CDS (29)..(616)
ctgagatcaccggcgaaggagggccaccatgtacaggatgcaactcctgtcttgcattgcactaagtcttgcacttgtcacgaattcttatgagaagcctgctctgcatttggctgctctgaacatgccattttctggggacattcgagctgattttcagtgcttcaagcaggccagagctgcaggactgttgtccacctaccgagcattcttatcttcccatttgcaagatctgtccaccattgtgaggaaagcagagagatacagccttcccatagtgaacctcaagggccaagtactttttaataattgggactcaattttttctggccacggaggtcagttcaatatgcatattccaatatactcctttgatggtcgagacataatgacagatccttcttggccccagaaagtcatttggcatggctccagcccccatggcgtccgccttgtggataactactgtgaagcatggcgaaccgcggacacagcggtcacgggacttgcctccccgctgagcacggggaagattctggaccagaaagcatacagctgtgctaatcggctaattgtcctatgtatcgaaaacagtttcatgacagacgctaggaagtaag

SEQ ID NO: 47 - protein, 196 aa, Homo sapiens
MYRMQLLSCIALSLALVTNSYEKPALHLAALNMPFSGDIRADFQCFKQARAAGLLSTYRAFLSSHLQDLSTIVRKAERYSLPIVNLKGQVLFNNWDSIFSGHGGQFNMHIPIYSFDGRDIMTDPSWPQKVIWHGSSPHGVRLVDNYCEAWRTADTAVTGLASPLSTGKILDQKAYSCANRLIVLCIENSFMTDARK

SEQ ID NO: 48 - DNA, 620 bp, Mus musculus
  CDS (29)..(616)
ctgagatcaccggcgaaggagggccaccatgtacaggatgcaactcctgtcttgcattgcactaagtcttgcacttgtcacgaattcctatgagaggcctgttctgcacctggttgctctgaacacaccggtggctggggacatccgagctgatttccagtgcttccagcaggccagggctgcaggcctcctgtccactttccgagcctttctgtcttcacacctgcaggatctctccacagtcgtgcggaaggcagagaggttcggccttccaattgtgaatctcaagggccaagtgctttttaacaattgggactcgatattttctggtgatggaggtcaattcaatacacacattccaatctactcctttgacggtcgggatgtgatgactgatccttcctggccccagaaggtggtctggcacggctccaacccccatggtgtccgtcttgtggacaagtactgtgaagcctggcgaaccacggacatggcagtaaccggatttgcctccccactgagcacagggaagattctggaccagaaagcttacagctgtgctaacaggctaatcgtgctgtgcatcgaaaacagtttcatgacagacactaggaagtgag

SEQ ID NO: 49 - protein, 196 aa, Mus musculus
MYRMQLLSCIALSLALVTNSYERPVLHLVALNTPVAGDIRADFQCFQQARAAGLLSTFRAFLSSHLQDLSTVVRKAERFGLPIVNLKGQVLFNNWDSIFSGDGGQFNTHIPIYSFDGRDVMTDPSWPQKVVWHGSNPHGVRLVDKYCEAWRTTDMAVTGFASPLSTGKILDQKAYSCANRLIVLCIENSFMTDTRK

SEQ ID NO: 50 - DNA, 651 bp, Homo sapiens
  CDS (29)..(640)
ctgagatcaccggcgaaggagggccaccatgtacaggatgcaactcctgtcttgcattgcactaagtcttgcacttgtcacgaattcggcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtaggctagctc

SEQ ID NO: 51 - protein, 204 aa, Homo sapiens
MYRMQLLSCIALSLALVTNSAHSHRDFQPVLHLVALNSPLSGGMRGIRGADFQCFQQARAVGLAGTFRAFLSSRLQDLYSIVRRADRAAVPIVNLKDELLFPSWEALFSGSEGPLKPGARIFSFDGKDVLRHPTWPQKSVWHGSDPNGRRLTESYCETWRTEAPSATGQASSLLGGRLLGQSAASCHHAYIVLCIENSFMTASK

SEQ ID NO: 52 - DNA, 689 bp, Mus musculus
  CDS (29)..(643)
ctgagatcaccggcgaaggagggccaccatgtacaggatgcaactcctgtcttgcattgcactaagtcttgcacttgtcacgaattcggctcatactcatcaggactttcagccagtgctccacctggtggcactgaacacccccctgtctggaggcatgcgtggtatccgtggagcagatttccagtgcttccagcaagcccgagccgtggggctgtcgggcaccttccgggctttcctgtcctctaggctgcaggatctctatagcatcgtgcgccgtgctgaccgggggtctgtgcccatcgtcaacctgaaggacgaggtgctatctcccagctgggactccctgttttctggctcccagggtcaactgcaacccggggcccgcatcttttcttttgacggcagagatgtcctgagacacccagcctggccgcagaagagcgtatggcacggctcggaccccagtgggcggaggctgatggagagttactgtgagacatggcgaactgaaactactggggctacaggtcaggcctcctccctgctgtcaggcaggctcctggaacagaaagctgcgagctgccacaacagctacatcgtcctgtgcattgagaatagcttcatgacctctttctccaaatagggcctctgccagctagggtggcagacagaggccatgctagctc

SEQ ID NO: 53 - protein, 205 aa, Mus musculus
MYRMQLLSCIALSLALVTNSAHTHQDFQPVLHLVALNTPLSGGMRGIRGADFQCFQQARAVGLSGTFRAFLSSRLQDLYSIVRRADRGSVPIVNLKDEVLSPSWDSLFSGSQGQLQPGARIFSFDGRDVLRHPAWPQKSVWHGSDPSGRRLMESYCETWRTETTGATGQASSLLSGRLLEQKAASCHNSYIVLCIENSFMTSFSK

SEQ ID NO: 54 - DNA, 333 bp, Homo sapiens
  CDS (29)..(322)
ctgagatcaccggcgaaggagggccaccatgaatcaaactgccattctgatttgctgccttatctttctgactctaagtggcattcaaggagtacctctctctagaactgtacgctgtacctgcatcagcattagtaatcaacctgttaatccaaggtctttagaaaaacttgaaattattcctgcaagccaattttgtccacgtgttgagatcattgctacaatgaaaaagaagggtgagaagagatgtctgaatccagaatcgaaggccatcaagaatttactgaaagcagttagcaaggaaaggtctaaaagatctccttaagctagctc

SEQ ID NO: 55 - protein, 98 aa, Homo sapiens
MNQTAILICCLIFLTLSGIQGVPLSRTVRCTCISISNQPVNPRSLEKLEIIPASQFCPRVEIIATMKKKGEKRCLNPESKAIKNLLKAVSKERSKRSP

SEQ ID NO: 56 - DNA, 389 bp, Mus musculus
  CDS (27)..(320)
ctgagatcaccggtaggagggccatcatgaacccaagtgctgccgtcattttctgcctcatcctgctgggtctgagtgggactcaagggatccctctcgcaaggacggtccgctgcaactgcatccatatcgatgacgggccagtgagaatgagggccatagggaagcttgaaatcatccctgcgagcctatcctgcccacgtgttgagatcattgccacgatgaaaaagaatgatgagcagagatgtctgaatccggaatctaagaccatcaagaatttaatgaaagcgtttagccaaaaaaggtctaaaagggctccttaactggagtgaagccacgcacacaccccggtgctgcgatggatggacagcagagagcctcgctagctc

SEQ ID NO: 57 - protein, 98 aa, Mus musculus
MNPSAAVIFCLILLGLSGTQGIPLARTVRCNCIHIDDGPVRMRAIGKLEIIPASLSCPRVEIIATMKKNDEQRCLNPESKTIKNLMKAFSQKRSKRAP

SEQ ID NO: 58 - DNA, 1451 bp, Homo sapiens
  CDS (29)..(1447)
ctgagatcaccggcgaaggagggccaccatgtacaggatgcaactcctgtcttgcattgcactaagtcttgcacttgtcacgaattctaaagtgtatctctcagagtgcaagactgggaatggaaagaactacagagggacgatgtccaaaacaaaaaatggcatcacctgtcaaaaatggagttccacttctccccacagacctagattctcacctgctacacacccctcagagggactggaggagaactactgcaggaatccagacaacgatccgcaggggccctggtgctatactactgatccagaaaagagatatgactactgcgacattcttgagtgtgaagaggaatgtatgcattgcagtggagaaaactatgacggcaaaatttccaagaccatgtctggactggaatgccaggcctgggactctcagagcccacacgctcatggatacattccttccaaatttccaaacaagaacctgaagaagaattactgtcgtaaccccgatagggagctgcggccttggtgtttcaccaccgaccccaacaagcgctgggaactttgtgacatcccccgctgcacaacacctccaccatcttctggtcccacctaccagtgtctgaagggaacaggtgaaaactatcgcgggaatgtggctgttaccgtgtccgggcacacctgtcagcactggagtgcacagacccctcacacacataacaggacaccggaaaactttccctgcaaaaatttggatgaaaactactgccgcaatcctgacggaaaaagggccccatggtgccatacaaccaacagccaagtgcggtgggagtactgtaagataccgtcctgtgactcctccccagtatccacggaacaattggctcccacagcaccacctgagctaacccctgtggtccaggactgctaccatggtgatggacagagctaccgaggcacatcctccaccaccaccacaggaaagaagtgtcagtcttggtcatctatgacaccacaccggcaccagaagaccccagaaaactacccaaatgctggcctgacaatgaactactgcaggaatccagatgccgataaaggcccctggtgttttaccacagaccccagcgtcaggtgggagtactgcaacctgaaaaaatgctcaggaacagaagcgagtgttgtagcacctccgcctgttgtcctgcttccagatgtagagactccttccgaagaagactgtatgtttgggaatgggaaaggataccgaggcaagagggcgaccactgttactgggacgccatgccaggactgggctgcccaggagccccatagacacagcattttcactccagagacaaatccacgggcgggtctggaaaaaaattactgccgtaaccctgatggtgatgtaggtggtccctggtgctacacgacaaatccaagataag

SEQ ID NO: 59 - protein, 473 aa, Homo sapiens
MYRMQLLSCIALSLALVTNSKVYLSECKTGNGKNYRGTMSKTKNGITCQKWSSTSPHRPRFSPATHPSEGLEENYCRNPDNDPQGPWCYTTDPEKRYDYCDILECEEECMHCSGENYDGKISKTMSGLECQAWDSQSPHAHGYIPSKFPNKNLKKNYCRNPDRELRPWCFTTDPNKRWELCDIPRCTTPPPSSGPTYQCLKGTGENYRGNVAVTVSGHTCQHWSAQTPHTHNRTPENFPCKNLDENYCRNPDGKRAPWCHTTNSQVRWEYCKIPSCDSSPVSTEQLAPTAPPELTPVVQDCYHGDGQSYRGTSSTTTTGKKCQSWSSMTPHRHQKTPENYPNAGLTMNYCRNPDADKGPWCFTTDPSVRWEYCNLKKCSGTEASVVAPPPVVLLPDVETPSEEDCMFGNGKGYRGKRATTVTGTPCQDWAAQEPHRHSIFTPETNPRAGLEKNYCRNPDGDVGGPWCYTTNPR

SEQ ID NO: 60 - DNA, 1451 bp, Mus musculus
  CDS (29)..(1447)
ctgagatcaccggcgaaggagggccaccatgtacaggatgcaactcctgtcttgcattgcactaagtcttgcacttgtcacgaattctagagtgtatctgtcagaatgtaagaccggcatcggcaacggctacagaggaaccatgtccaggacaaagagtggtgttgcctgtcaaaagtggggtgccacgttcccccacgtacccaactactctcccagtacacatcccaatgagggactagaagagaactactgtaggaacccagacaatgatgaacaagggccttggtgctacactacagatccggacaagagatatgactactgcaacattcctgaatgtgaagaggaatgcatgtactgcagtggagaaaagtatgagggcaaaatctccaagaccatgtctggacttgactgccaggcctgggattctcagagcccacatgctcatggatacatccctgccaaatttccaagcaagaacctgaagatgaattattgccgcaaccctgacggggagccaaggccctggtgcttcacaacagaccccaccaaacgctgggaatactgtgacatcccccgctgcacaacacccccgcccccacccagcccaacctaccaatgtctgaaaggaagaggtgaaaattaccgagggaccgtgtctgtcaccgtgtctgggaaaacctgtcagcgctggagtgagcaaacccctcataggcacaacaggacaccagaaaatttcccctgcaaaaatctggaagagaactactgccggaacccagatggagaaactgctccctggtgctataccactgacagccagctgaggtgggagtactgtgagattccatcctgcgagtcctcagcatcaccagaccagtcagattcctcagttccaccagaggagcaaacacctgtggtccaggaatgctaccagagcgatgggcagagctatcggggtacatcgtccactaccatcacagggaagaagtgccagtcctgggcagctatgtttccacacaggcattcgaagaccccagagaacttcccagatgctggcttggagatgaactactgcaggaacccggatggtgacaagggcccttggtgctacaccactgacccgagcgtcaggtgggaatactgcaacctgaagcggtgctcagagacaggagggagtgttgtggaattgcccacagtttcccaggaaccaagtgggccgagcgactctgagacagactgcatgtatgggaatggcaaagactatcggggcaaaacggccgtcactgcagctggcaccccctgccagggatgggctgcccaggagccccacaggcacagcatcttcaccccacagacaaacccacgggcaggtctggaaaagaactactgccgaaacccagatggggatgtgaatggtccttggtgctatacaacaaaccccagatgag

SEQ ID NO: 61 - protein, 473 aa, Mus musculus
MYRMQLLSCIALSLALVTNSRVYLSECKTGIGNGYRGTMSRTKSGVACQKWGATFPHVPNYSPSTHPNEGLEENYCRNPDNDEQGPWCYTTDPDKRYDYCNIPECEEECMYCSGEKYEGKISKTMSGLDCQAWDSQSPHAHGYIPAKFPSKNLKMNYCRNPDGEPRPWCFTTDPTKRWEYCDIPRCTTPPPPPSPTYQCLKGRGENYRGTVSVTVSGKTCQRWSEQTPHRHNRTPENFPCKNLEENYCRNPDGETAPWCYTTDSQLRWEYCEIPSCESSASPDQSDSSVPPEEQTPVVQECYQSDGQSYRGTSSTTITGKKCQSWAAMFPHRHSKTPENFPDAGLEMNYCRNPDGDKGPWCYTTDPSVRWEYCNLKRCSETGGSVVELPTVSQEPSGPSDSETDCMYGNGKDYRGKTAVTAAGTPCQGWAAQEPHRHSIFTPQTNPRAGLEKNYCRNPDGDVNGPWCYTTNPR

SEQ ID NO: 62 - DNA, 401 bp, Homo sapiens
  CDS (29)..(391)
ctgagatcaccggcgaaggagggccaccatgtacaggatgcaactcctgtcttgcattgcactaagtcttgcacttgtcacgaattcgcctgttgtcctgcttccagatgtagagactccttccgaagaacactgtatgtttgggaatgggaaaggataccgaggcaagagggcgaccactgttactgggacgccatgccaggactgggctgcccaggagccccatagacacagcattttcactccagagacaaatccacgggcgggtctggaaaaaaattactgccgtaaccctgatggtgatgtaggtggtccctggtgctacacgacaaatccaagaaaactttacgactactgtgatgtccctcagtgtgcggccccttcatttgattagctagctc

SEQ ID NO: 63 - protein, 121 aa, Homo sapiens
MYRMQLLSCIALSLALVTNSPVVLLPDVETPSEEHCMFGNGKGYRGKRATTVTGTPCQDWAAQEPHRHSIFTPETNPRAGLEKNYCRNPDGDVGGPWCYTTNPRKLYDYCDVPQCAAPSFD

SEQ ID NO: 64 - DNA, 1210 bp, Mus musculus
  CDS (27)..(1154)
ctgagatcaccggtaggagggccatcatgattgatgccctgagactggcaaattcagcttttgctgttgacttgttcaaacaactatgtgaaagggacccagcaggaaacattctcttctctccaatatgcctctctacttctctgtcccttgcgcaagtgggcaccaaaggcgacacagcaaatgaaattggacaggtccttcattttgagaatgtcaaagatgtaccctttgggtttcaaacagtcacttctgatgttaataagctcagttctttttactctttgaaacttgtcaagcgactctacatagacaaatctctgaacccttctacagaatttatcagttctaccaaaagaccatatgcaaaagaattggaaactgttgacttcaaagacaaactggaagaaacgaaaggtcaaattaacagctccattaaggagctcacagatggccactttgaggacattttgtcagagaacagtataagtgaccagaccaaaatccttgtggttaatgctgcctactttgttggaaagtggatgaagaaatttccggaatcagaaacaaaagaatgtcctttcagaatcagcaagacagacaccaaacccgtacaaatgatgaatcttgaggccactttctgcttgggtaacattgatgacatcagctgtaagatcatagaacttcctttccagaataagcatctgagtatgctcattgtgctccccaaggacgtggaggatgagtccacaggcctggagaagattgaacagcaactcaacccagaaacattgttacagtggaccaaccccagtaccatggccaatgccaaagtcaaactttccctcccaaagtttaaggtagaaaagatgattgatcccaaggctagtctggaaagcctagggctgaaaagtctcttcaatgaaagtacatcggatttctctggaatgtcagagaccaagggagtgtccctgtcaaatgtgattcatagagtatgcctagaaataaccgaagatggtggtgagtccatcgaggtgccagggtcccggatcttacagcacaaggatgaattcaatgctgaccatccatttatttatatcattagacacaacaaaactcgaaacatcattttctttggcaaattctgttctccttagctggcagggccttgccaagtctcagggaacttgtctgtagtcgcagagctctg

SEQ ID NO: 65 - protein, 376 aa, Mus musculus
MIDALRLANSAFAVDLFKQLCERDPAGNILFSPICLSTSLSLAQVGTKGDTANEIGQVLHFENVKDVPFGFQTVTSDVNKLSSFYSLKLVKRLYIDKSLNPSTEFISSTKRPYAKELETVDFKDKLEETKGQINSSIKELTDGHFEDILSENSISDQTKILVVNAAYFVGKWMKKFPESETKECPFRISKTDTKPVQMMNLEATFCLGNIDDISCKIIELPFQNKHLSMLIVLPKDVEDESTGLEKIEQQLNPETLLQWTNPSTMANAKVKLSLPKFKVEKMIDPKASLESLGLKSLFNESTSDFSGMSETKGVSLSNVIHRVCLEITEDGGESIEVPGSRILQHKDEFNADHPFIYIIRHNKTRNIIFFGKFCSP

SEQ ID NO: 66 - DNA, 495 bp, Homo sapiens
  CDS (27)..(401)
ctgagatcaccggtaggagggccatcatgaagaaaagtggtgttcttttcctcttgggcatcatcttgctggttctgattggagtgcaaggaaccccagtagtgagaaagggtcgctgttcctgcatcagcaccaaccaagggactatccacctacaatccttgaaagaccttaaacaatttgccccaagcccttcctgcgagaaaattgaaatcattgctacactgaagaatggagttcaaacatgtctaaacccagattcagcagatgtgaaggaactgattaaaaagtgggagaaacaggtcagccaaaagaaaaagcaaaagaatgggaaaaaacatcaaaaaaagaaagttctgaaagttcgaaaatctcaacgttctcgtcaaaagaagactacataagagaccacttcaccaataagtattctgtgttaaaaatgttctattttaattataccgctatcattccaaaggaggatggcatagctagctc

SEQ ID NO: 67 - protein, 125 aa, Homo sapiens
MKKSGVLFLLGIILLVLIGVQGTPVVRKGRCSCISTNQGTIHLQSLKDLKQFAPSPSCEKIEIIATLKNGVQTCLNPDSADVKELIKKWEKQVSQKKKQKNGKKHQKKKVLKVRKSQRSRQKKTT

SEQ ID NO: 68 - DNA, 446 bp, Mus musculus
  CDS (29)..(406)
ctgagatcaccggcgaaggagggccaccatgaagtccgctgttcttttcctcttgggcatcatcttcctggagcagtgtggagttcgaggaaccctagtgataaggaatgcacgatgctcctgcatcagcaccagccgaggcacgatccactacaaatccctcaaagacctcaaacagtttgccccaagccccaattgcaacaaaactgaaatcattgctacactgaagaacggagatcaaacctgcctagatccggactcggcaaatgtgaagaagctgatgaaagaatgggaaaagaagatcagccaaaagaaaaagcaaaagagggggaaaaaacatcaaaagaacatgaaaaacagaaaacccaaaacaccccaaagtcgtcgtcgttcaaggaagactacataagagaccattactttaccaacaagcaccctgctagctc

SEQ ID NO: 69 - protein, 126 aa, Mus musculus
MKSAVLFLLGIIFLEQCGVRGTLVIRNARCSCISTSRGTIHYKSLKDLKQFAPSPNCNKTEIIATLKNGDQTCLDPDSANVKKLMKEWEKKISQKKKQKRGKKHQKNMKNRKPKTPQSRRRSRKTT

SEQ ID NO: 70 - DNA, 1309 bp, Homo sapiens
  CDS (27)..(1280)
ctgagatcaccggtaggagggccagcatgcaggccctggtgctactcctctgcattggagccctcctcgggcacagcagctgccagaaccctgccagccccccggaggagggctccccagaccccgacagcacaggggcgctggtggaggaggaggatcctttcttcaaagtccccgtgaacaagctggcagcggctgtctccaacttcggctatgacctgtaccgggtgcgatccagcacgagccccacgaccaacgtgctcctgtctcctctcagtgtggccacggccctctcggccctctcgctgggagcggagcagcgaacagaatccatcattcaccgggctctctactatgacttgatcagcagcccagacatccatggtacctataaggagctccttgacacggtcaccgccccccagaagaacctcaagagtgcctcccggatcgtctttgagaagaagctgcgcataaaatccagctttgtggcacctctggaaaagtcatatgggaccaggcccagagtcctgacgggcaaccctcgcttggacctgcaagagatcaacaactgggtgcaggcgcagatgaaagggaagctcgccaggtccacaaaggaaattcccgatgagatcagcattctccttctcggtgtggcgcacttcaaggggcagtgggtaacaaagtttgactccagaaagacttccctcgaggatttctacttggatgaagagaggaccgtgagggtccccatgatgtcggaccctaaggctgttttacgctatggcttggattcagatctcagctgcaagattgcccagctgcccttgaccggaagcatgagtatcatcttcttcctgcccctgaaagtgacccagaatttgaccttgatagaggagagcctcacctccgagttcattcatgacatagaccgagaactgaagaccgtgcaggcggtcctcactgtccccaagctgaagctgagttatgaaggcgaagtcaccaagtccctgcaggagatgaagctgcaatccttgtttgattcaccagactttagcaagatcacaggcaaacccatcaagctgactcaggtggaacaccgggctggctttgagtggaacgaggatggggcgggaaccacccccagcccagggctgcagcctgcccacctcaccttcccgctggactatcaccttaaccagcctttcatcttcgtactgagggacacagacacaggggcccttctcttcattggcaagattctggaccccaggggcccctaatatcccagtttaatattccaataccg

SEQ ID NO: 71 - protein, 418 aa, Homo sapiens
MQALVLLLCIGALLGHSSCQNPASPPEEGSPDPDSTGALVEEEDPFFKVPVNKLAAAVSNFGYDLYRVRSSTSPTTNVLLSPLSVATALSALSLGAEQRTESIIHRALYYDLISSPDIHGTYKELLDTVTAPQKNLKSASRIVFEKKLRIKSSFVAPLEKSYGTRPRVLTGNPRLDLQEINNWVQAQMKGKLARSTKEIPDEISILLLGVAHFKGQWVTKFDSRKTSLEDFYLDEERTVRVPMMSDPKAVLRYGLDSDLSCKIAQLPLTGSMSIIFFLPLKVTQNLTLIEESLTSEFIHDIDRELKTVQAVLTVPKLKLSYEGEVTKSLQEMKLQSLFDSPDFSKITGKPIKLTQVEHRAGFEWNEDGAGTTPSPGLQPAHLTFPLDYHLNQPFIFVLRDTDTGALLFIGKILDPRGP

SEQ ID NO: 72 - DNA, 1317 bp, Mus musculus
  CDS (27)..(1277)
ctgagatcaccggtaggagggccagcatgcaggccctggtgctactcctctggactggagccctgctcgggcacggcagcagccagaacgtccccagcagctctgagggctccccagtcccggacagcacgggcgagcccgtggaggaggaggaccccttcttcaaggtccctgtgaacaagctggcagcagctgtctccaacttcggctacgatctgtaccgcctgagatccagtgccagcccaacgggcaacgtcctgctgtctccactcagcgtggccacggccctctctgccctttctctgggagctgaacatcgaacagagtctgtcattcaccgggctctctactacgacctgatcaccaaccctgacatccacagcacctacaaggagctccttgcctctgttactgcccctgagaagaacctcaagagtgcttccagaattgtgtttgagaggaaacttcgagtcaaatccagctttgttgcccctctggagaagtcctatgggaccaggccccggatcctcacgggcaaccctcgagtagaccttcaggagattaacaactgggtgcaggcccagatgaaagggaagattgcccggtccacgagggaaatgcccagtgccctcagcatccttctccttggcgtggcttacttcaaggggcagtgggtaaccaagtttgactcgagaaagacgaccctccaggattttcatttggacgaggacaggaccgtgagagtccccatgatgtcagatcctaaggccatcttacgatacggcttggactctgatctcaactgcaagattgcccagctgcccttgacaggaagtatgagcatcatcttcttcctgcccctgaccgtgacccagaacttgaccatgatagaagagagcctcacctctgagttcattcatgacatcgaccgagaactgaagactatccaagctgtgctgactgtccccaagctgaagctgagcttcgaaggcgaacttaccaagtctctgcaggacatgaagctacagtcgttgtttgaatcacccgacttcagcaagattactggcaaacccgtgaagctcacccaagtggaacacagggctgctttcgagtggaatgaagagggggcaggaagcagccccagcccaggcctccagcccgtccgcctcaccttcccgctagactatcaccttaaccaacctttcctctttgttctgagggacacggacacgggggccctcctcttcataggcagaatcctggaccccagtagtacttaatgtctcagtgctctacagaacccccagagggaagctg

SEQ ID NO: 73 - protein, 417 aa, Mus musculus
MQALVLLLWTGALLGHGSSQNVPSSSEGSPVPDSTGEPVEEEDPFFKVPVNKLAAAVSNFGYDLYRLRSSASPTGNVLLSPLSVATALSALSLGAEHRTESVIHRALYYDLITNPDIHSTYKELLASVTAPEKNLKSASRIVFERKLRVKSSFVAPLEKSYGTRPRILTGNPRVDLQEINNWVQAQMKGKIARSTREMPSALSILLLGVAYFKGQWVTKFDSRKTTLQDFHLDEDRTVRVPMMSDPKAILRYGLDSDLNCKIAQLPLTGSMSIIFFLPLTVTQNLTMIEESLTSEFIHDIDRELKTIQAVLTVPKLKLSFEGELTKSLQDMKLQSLFESPDFSKITGKPVKLTQVEHRAAFEWNEEGAGSSPSPGLQPVRLTFPLDYHLNQPFLFVLRDTDTGALLFIGRILDPSST

SEQ ID NO: 74 - DNA, 711 bp, Homo sapiens
  CDS (29)..(664)
ctgagatcaccggcgaaggagggccaccatgtacaggatgcaactcctgtcttgcattgcactaagtcttgcacttgtcacgaattcgtgcaaacaggacattgtatttgatggcatccctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccttggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggctttcccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgctagctc

SEQ ID NO: 75 - protein, 212 aa, Homo sapiens
MYRMQLLSCIALSLALVTNSCKQDIVFDGIPQIRGEIFFFKDRFIWRTVTPRDKPMGPLLVATFWPELPEKIDAVYEAPQEEKAVFFAGNEYWIYSASTLERGYPKPLTSLGLPPDVQRVDAAFNWSKNKKTYIFAGDKFWRYNEVKKKMDPGFPKLIADAWNAIPDNLDAVVDLQGGGHSYFFKGAYYLKLENQSLKSVKFGSIKSDWLGC

SEQ ID NO: 76 - DNA, 711 bp, Mus musculus
  CDS (29)..(664)
ctgagatcaccggcgaaggagggccaccatgtacaggatgcaactcctgtcttgcattgcactaagtcttgcacttgtcacgaattcgtgcaaacaggacattgtctttgatggcatcgctcagatccgtggtgagatcttcttcttcaaggaccggtttatttggcggacagtgacaccacgtgacaagcccacaggtcccttgctggtggccacattctggcctgagctcccagaaaagattgacgctgtgtatgaggccccacaggaggagaaggctgtgttcttcgcagggaatgagtactgggtctattctgccagcactctggagcgaggataccccaagccactgaccagcctggggttgccccctgatgtccagcaagtagatgctgcctttaactggagtaagaacaagaagacatacatctttgcaggagacaagttctggagatacaatgaagtgaagaagaaaatggacccgggtttccctaagctcatcgcagactcctggaatgccatccctgataacctggatgctgtcgtggacctgcagggcggtggtcatagctacttcttcaagggtgcttattacctgaagctggagaaccaaagtctcaagagcgtgaagtttggaagcatcaaatcagactggctgggctgctgagctggccctgttcccacgggccctatcatcttcatcgctagctc

SEQ ID NO: 77 - protein, 212 aa, Mus musculus
MYRMQLLSCIALSLALVTNSCKQDIVFDGIAQIRGEIFFFKDRFIWRTVTPRDKPTGPLLVATFWPELPEKIDAVYEAPQEEKAVFFAGNEYWVYSASTLERGYPKPLTSLGLPPDVQQVDAAFNWSKNKKTYIFAGDKFWRYNEVKKKMDPGFPKLIADSWNAIPDNLDAVVDLQGGGHSYFFKGAYYLKLENQSLKSVKFGSIKSDWLGC

SEQ ID NO: 78 - DNA, 363 bp, Homo sapiens
  CDS (27)..(329)
ctgagatcaccggtaggagggccatcatgagctccgcagccgggttctgcgcctcacgccccgggctgctgttcctggggttgctgctcctgccacttgtggtcgccttcgccagcgctgaagctgaagaagatggggacctgcagtgcctgtgtgtgaagaccacctcccaggtccgtcccaggcacatcaccagcctggaggtgatcaaggccggaccccactgccccactgcccaactgatagccacgctgaagaatggaaggaaaatttgcttggacctgcaagccccgctgtacaagaaaataattaagaaacttttggagagttagctactagctgcctacgtgtgtgcatttgctg

SEQ ID NO: 79 - protein, 101 aa, Homo sapiens
MSSAAGFCASRPGLLFLGLLLLPLVVAFASAEAEEDGDLQCLCVKTTSQVRPRHITSLEVIKAGPHCPTAQLIATLKNGRKICLDLQAPLYKKIIKKLLES

SEQ ID NO: 80 - DNA, 359 bp, Mus musculus
  CDS (27)..(341)
ctgagatcaccggtaggagggccatcatgagcgtcgctgcggtgtttcgaggcctccggcctagtcctgagctgctgcttctgggcctgttgtttctgccagcggtggttgctgtcaccagcgctggtcccgaagaaagcgatggagatcttagctgtgtgtgtgtgaagaccatctcctctgggatccatcttaagcacatcaccagcctggaggtgatcaaggcaggacgccactgtgcggttccccagctcatagccaccctgaagaatgggaggaaaatttgcctggaccggcaagcacccctatataagaaagtaatcaagaaaatcctggagagttaggtatcagctgcctag

SEQ ID NO: 81 - protein, 105 aa, Mus musculus
MSVAAVFRGLRPSPELLLLGLLFLPAVVAVTSAGPEESDGDLSCVCVKTISSGIHLKHITSLEVIKAGRHCAVPQLIATLKNGRKICLDRQAPLYKKVIKKILES

SEQ ID NO: 82 - DNA, 814 bp, Mus musculus
  CDS (27)..(758)
ctgagatcaccggtaggagggccagcatgctcccttctttgatccaaccgtgctcctcagggactctcctgatgctgttgatgtcaaatctcttcctgtgggagaaggtgtcctctgcacccataaatgccagtgaggctgttctcagtgatctgaaggacttgtttgataatgccactgtactttctggagagatgtctaagcttggtgtaatcatgcgcaaagaatttttcatgaactcattctcttcagagacgttcaataagattatattagatttgcacaagagtacggagaatataaccaaggctttcaacagctgccacactgttcccatcaacgttcctgaaacagttgaggatgtccgaaagacatcgtttgaagagtttttgaaaatggtgctccatatgctgctagcctggaaagagcctctgaaacatctagtgacagaactcagtgctttgccagaatgcccttataggatcctatcaaaggccgaagccattgaggcaaaaaacaaagaccttctagagtacatcataagaataatatctaaggttaatcctgcaatcaaagaaaatgaagactacccgacctggtcagatttggactccctgaagtcagctgataaagaaactcaattttttgctctttatatgttttccttctgcctgcgtattgacctagaaacagttgattttctagtcaatttcctaaaatgtctgcttctttatgatgatgtctgctactctgaattttgagatattacatgatccatcttttggaatcttcttctagtctttgcacgaattcg

SEQ ID NO: 83 - protein, 244 aa, Mus musculus
MLPSLIQPCSSGTLLMLLMSNLFLWEKVSSAPINASEAVLSDLKDLFDNATVLSGEMSKLGVIMRKEFFMNSFSSETFNKIILDLHKSTENITKAFNSCHTVPINVPETVEDVRKTSFEEFLKMVLHMLLAWKEPLKHLVTELSALPECPYRILSKAEAIEAKNKDLLEYIIRIISKVNPAIKENEDYPTWSDLDSLKSADKETQFFALYMFSFCLRIDLETVDFLVNFLKCLLLYDDVCYSEF

SEQ ID NO: 84 - DNA, 660 bp, Homo sapiens
  CDS (29)..(649)
ctgagatcaccggcgaaggagggccaccatggcaccctttgagcccctggcttctggcatcctgttgttgctgtggctgatagcccccagcagggcctgcacctgtgtcccaccccacccacagacggccttctgcaattccgacctcgtcatcagggccaagttcgtggggacaccagaagtcaaccagaccaccttataccagcgttatgagatcaacatgaccaagatgtataaagggttccaagccttaggggatgccgctgacatccggttcgtctacacccccgccatggagagtgtctgcggatacttccacaggtcccacaaccgcagcgaggagtttctcattgctggaaaactgcaggatggactcttgcacatcactacctgcagtttcgtggctccctggaacagcctgagcttagctcagcgccggggcttcaccaagacctacactgttggctgtgaggaatgcacagtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgagctagctc

SEQ ID NO: 85 - protein, 207 aa, Homo sapiens
MAPFEPLASGILLLLWLIAPSRACTCVPPHPQTAFCNSDLVIRAKFVGTPEVNQTTLYQRYEINMTKMYKGFQALGDAADIRFVYTPAMESVCGYFHRSHNRSEEFLIAGKLQDGLLHITTCSFVAPWNSLSLAQRRGFTKTYTVGCEECTVFPCLSIPCKLQSGTHCLWTDQLLQGSEKGFQSRHLACLPREPGLCTWQSLRSQIA

SEQ ID NO: 86 - DNA, 645 bp, Mus musculus
  CDS (27)..(641)
ctgagatcaccggtaggagggccatcatgatggccccctttgcatctctggcatctggcatcctcttgttgctatcactgatagcttccagtaaggcctgtagctgtgccccaccccacccacagacagccttctgcaactcggacctggtcataagggctaaattcatgggttccccagaaatcaacgagaccaccttataccagcgttataagatcaagatgactaagatgctaaaaggattcaaggctgtgggaaatgccgcagatatccggtacgcctacaccccagtcatggaaagcctctgtggatatgcccacaagtcccagaaccgcagtgaagagtttctcatcacgggccgcctaaggaacggaaatttgcacatcagtgcctgcagcttcttggttccctggcgtactctgagccctgctcagcaaagagctttctcaaagacctatagtgctggctgtggggtgtgcacagtgtttccctgtttatctatcccttgcaaactggagagtgacactcactgtttgtggacggatcaggtcctcgtgggctctgaggactaccagagccgtcactttgcttgcctgccacggaatccaggcttgtgcacctggagatcccttggggcccgatgag

SEQ ID NO: 87 - protein, 205 aa, Mus musculus
MMAPFASLASGILLLLSLIASSKACSCAPPHPQTAFCNSDLVIRAKFMGSPEINETTLYQRYKIKMTKMLKGFKAVGNAADIRYAYTPVMESLCGYAHKSQNRSEEFLITGRLRNGNLHISACSFLVPWRTLSPAQQRAFSKTYSAGCGVCTVFPCLSIPCKLESDTHCLWTDQVLVGSEDYQSRHFACLPRNPGLCTWRSLGAR

SEQ ID NO: 88 - DNA, 699 bp, Homo sapiens
  CDS (29)..(688)
ctgagatcaccggcgaaggagggccaccatgggcgccgcggcccgcaccctgcggctggcgctcggcctcctgctgctggcgacgctgcttcgcccggccgacgcctgcagctgctccccggtgcacccgcaacaggcgttttgcaatgcagatgtagtgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagctagctc

SEQ ID NO: 89 - protein, 220 aa, Homo sapiens
MGAAARTLRLALGLLLLATLLRPADACSCSPVHPQQAFCNADVVIRAKAVSEKEVDSGNDIYGNPIKRIQYEIKQIKMFKGPEKDIEFIYTAPSSAVCGVSLDVGGKKEYLIAGKAEGDGKMHITLCDFIVPWDTLSTTQKKSLNHRYQMGCECKITRCPMIPCYISSPDECLWMDWVTEKNINGHQAKFFACIKRSDGSCAWYRGAAPPKQEFLDIEDP

SEQ ID NO: 90 - DNA, 699 bp, Homo sapiens
  CDS (27)..(659)
ctgagatcaccggtaggagggccatcatgaccccttggctcgggctcatcgtgctcctgggcagctggagcctgggggactggggcgccgaggcgtgcacatgctcgcccagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccacacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcg

SEQ ID NO: 91 - protein, 211 aa, Homo sapiens
MTPWLGLIVLLGSWSLGDWGAEACTCSPSHPQDAFCNSDIVIRAKVVGKKLVKEGPFGTLVYTIKQMKMYRGFTKMPHVQYIHTEASESLCGLKLEVNKYQYLLTGRVYDGKMYTGLCNFVERWDQLTLSQRKGLNYRYHLGCNCKIKSCYYLPCFVTSKNECLWTDMLSNFGYPGYQSKHYACIRQKGGYCSWYRGWAPPDKSIINATDP

SEQ ID NO: 92 - DNA, 690 bp, Mus musculus
  CDS (29)..(661)
ctgagatcaccggcgaaggagggccaccatgactccctggcttgggcttgtcgtgctcctgagctgctggagccttgggcactggggcgcggaagcgtgcacatgctctcccagccatccccaggatgccttctgcaactccgacatcgtgatccgggccaaagtggtgggaaagaagctggtgaaggaggggccctttggcactctggtctacactattaagcagatgaagatgtaccgaggcttcagtaagatgccccacgtgcagtacattcacacggaagcctctgaaagtctttgtggcctcaagctagaagtcaacaaataccagtacctgctgacagggcgcgtgtatgaaggcaagatgtacacaggactgtgcaactttgtggagaggtgggaccacctcacactgtcccagcgcaagggcctcaattaccgctaccacctgggttgcaattgcaagatcaagtcctgctactacttgccttgttttgtgacctccaagaatgagtgtctctggaccgacatgctctccaattttgggtaccctggctatcagtccaaacactacgcctgcatccggcagaagggtggctactgcagctggtaccgaggatgggctcccccagacaagagcatcagcaacgccacagacccctgaacccagaccttccccaccgctagctc

SEQ ID NO: 93 - protein, 211 aa, Mus musculus
MTPWLGLVVLLSCWSLGHWGAEACTCSPSHPQDAFCNSDIVIRAKVVGKKLVKEGPFGTLVYTIKQMKMYRGFSKMPHVQYIHTEASESLCGLKLEVNKYQYLLTGRVYEGKMYTGLCNFVERWDHLTLSQRKGLNYRYHLGCNCKIKSCYYLPCFVTSKNECLWTDMLSNFGYPGYQSKHYACIRQKGGYCSWYRGWAPPDKSISNATDP

SEQ ID NO: 94 - DNA, 754 bp, Homo sapiens
  CDS (29)..(703)
ctgagatcaccggcgaaggagggccaccatggcccctgggagccctcggcccgcgccaagctgggtgctgttgctgcggctgctggcgttgctgcggcccccggggctgggtgaggcatgcagctgcgccccggcgcaccctcagcagcacatctgccactcggcacttgtgattcgggccaaaatctccagtgagaaggtagttccggccagtgcagaccctgctgacactgaaaaaatgctccggtatgaaatcaaacagataaagatgttcaaagggtttgagaaagtcaaggatgttcagtatatctatacgccttttgactcttccctctgtggtgtgaaactagaagccaacagccagaagcagtatctcttgactggtcaggtcctcagtgatggaaaagtcttcatccatctgtgcaactacatcgagccctgggaggacctgtccttggtgcagagggaaagtctgaatcatcactaccatctgaactgtggctgccaaatcaccacctgctacacagtaccctgtaccatctcggcccctaacgagtgcctctggacagactggctgttggaacgaaagctctatggttaccaggctcagcattatgtctgtatgaagcatgttgacggcacctgcagctggtaccggggccacctgcctctcaggaaggagtttgttgacatcgttcagccctagtagggaccagtgaccatcacatcccttcaagagtcctgaagctagctc

SEQ ID NO: 95 - protein, 225 aa, Homo sapiens
MAPGSPRPAPSWVLLLRLLALLRPPGLGEACSCAPAHPQQHICHSALVIRAKISSEKVVPASADPADTEKMLRYEIKQIKMFKGFEKVKDVQYIYTPFDSSLCGVKLEANSQKQYLLTGQVLSDGKVFIHLCNYIEPWEDLSLVQRESLNHHYHLNCGCQITTCYTVPCTISAPNECLWTDWLLERKLYGYQAQHYVCMKHVDGTCSWYRGHLPLRKEFVDIVQP

SEQ ID NO: 96 - DNA, 654 bp, Homo sapiens
  CDS (29)..(574)
ctgagatcaccggcgaaggagggccaccatgggagatgaggagaagcggaacagggccatcacggcccgcaggcagcacctgaagagtgtgatgctgcagatagcggccacggagctggagaaggaggagagccgccgtgaggcagagaagcagaactacctggcggagcactgcccgccgctgcatatcccgggctccatgtctgaagtgcaggagctctgcaaacagctgcacgccaagatcgatgcggctgaagaggagaagtacgacatggaggtgagggtgcagaagaccagcaaggagctggaggacatgaaccagaagctatttgatctgcggggcaagttcaagcggcccccactgcggagggtgcgcatgtcgaccgatgccatgctcaaggccctgctgggctcgaagcacaaggtgtgcatggacctgagggccaacctgaagcaggtcaagaaggaggacacagagaaggagcgggacctgcgagacgtgggtgactggaggaagaacatcgaggagaagtctggcatggagggccggaagaagatgtttgagtccgagtcctaggccactcgctgcccctacgcctgccccggtgcccggctcccagcagaacatactagggagatgcacccagctagctc

SEQ ID NO: 97 - protein, 182 aa, Homo sapiens
MGDEEKRNRAITARRQHLKSVMLQIAATELEKEESRREAEKQNYLAEHCPPLHIPGSMSEVQELCKQLHAKIDAAEEEKYDMEVRVQKTSKELEDMNQKLFDLRGKFKRPPLRRVRMSTDAMLKALLGSKHKVCMDLRANLKQVKKEDTEKERDLRDVGDWRKNIEEKSGMEGRKKMFESES

SEQ ID NO: 98 - DNA, 608 bp, Mus musculus
  CDS (29)..(574)
ctgagatcaccggcgaaggagggccaccatgggagatgaggagaagcgcaacagggccatcacggcccggagacagcacctgaagagtgtgatgctccagatagcggccacagagctggagaaagaggaaagccgccgagaatctgagaaggagaactacctgtcagaacactgcccgccactgcacatcccaggctccatgtctgaagtgcaggaactctgcaaacaactgcatgcgaagatcgacgtggctgaagaggagaaatatgacatggaggtgaaggtgcagaacagcagcaaggagctggaagacatgaaccagaagctatttgacctgaggggcaagttcaagaggcccccacttcggagggtgcgtatgtctgccgacgccatgctgaaggcgctgctgggctctaagcacaaggtgtgcatggacctgagggccaacctgaagcaggtcaagaaggaagacactgagaaggaacgggacctgcgtgacgtgggtgactggaggaagaatattgaggagaagtctggcatggagggccggaagaaaatgttcgagtctgagtcctaactgcccacttccccagtaccaccgctagctc

SEQ ID NO: 99 - protein, 182 aa, Mus musculus
MGDEEKRNRAITARRQHLKSVMLQIAATELEKEESRRESEKENYLSEHCPPLHIPGSMSEVQELCKQLHAKIDVAEEEKYDMEVKVQNSSKELEDMNQKLFDLRGKFKRPPLRRVRMSADAMLKALLGSKHKVCMDLRANLKQVKKEDTEKERDLRDVGDWRKNIEEKSGMEGRKKMFESES

SEQ ID NO: 100 - DNA, 1294 bp, Homo sapiens
  CDS (29)..(1222)
ctgagatcaccggcgaaggagggccaccatgtacaggatgcaactcctgtcttgcattgcactaagtcttgcacttgtcacgaattctagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgctgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcg

SEQ ID NO: 101 - protein, 398 aa, Homo sapiens
MYRMQLLSCIALSLALVTNSSAKGIDYDKLIVRFGSSKIDKELINRIERATGQRPHHFLRRGIFFSHRDMNQVLDAYENKKPFYLYTGRGPSSEAMHVGHLIPFIFTKWLQDVFNVPLVIQMTDDEKYLWKDLTLDQAYSYAVENAKDIIACGFDINKTFIFSDLDYMGMSSGFYKNVVKIQKHVTFNQVKGIFGFTDSDCIGKISFPAIQAAPSFSNSFPQIFRDRTDIQCLIPCAIDQDPYFRMTRDVAPRIGYPKPALLHSTFFPALQGAQTKMSASDPNSSIFLTDTAKQIKTKVNKHAFSGGRDTIEEHRQFGGNCDVDVSFMYLTFFLEDDDKLEQIRKDYTSGAMLTGELKKALIEVLQPLIAEHQARRKEVTDEIVKEFMTPRKLSFDFQ

SEQ ID NO: 102 - DNA, 3603 bp, Homo sapiens
  CDS (27)..(3539)
ctgagatcaccggtaggagggccatcatgatcgggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggag

SEQ ID NO: 103 - protein, 1171 aa, Homo sapiens
MIGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRFKQDGGWSHWSPWSSCSVTCGDGVITRIRLCNSPSPQMNGKPCEGEARETKACKKDACPINGGWGPWSPWDICSVTCGGGVQKRSRLCNNPTPQFGGKDCVGDVTENQICNKQDCPIDGCLSNPCFAGVKCTSYPDGSWKCGACPPGYSGNGIQCTDVDECKEVPDACFNHNGEHRCENTDPGYNCLPCPPRFTGSQPFGQGVEHATANKQVCKPRNPCTDGTHDCNKNAKCNYLGHYSDPMYRCECKPGYAGNGIICGEDTDLDGWPNENLVCVANATYHCKKDNCPNLPNSGQEDYDKDGIGDACDDDDDNDKIPDDRDNCPFHYNPAQYDYDRDDVGDRCDNCPYNHNPDQADTDNNGEGDACAADIDGDGILNERDNCQYVYNVDQRDTDMDGVGDQCDNCPLEHNPDQLDSDSDRIGDTCDNNQDIDEDGHQNNLDNCPYVPNANQADHDKDGKGDACDHDDDNDGIPDDKDNCRLVPNPDQKDSDGDGRGDACKDDFDHDSVPDIDDICPENVDISETDFRRFQMIPLDPKGTSQNDPNWVVRHQGKELVQTVNCDPGLAVGYDEFNAVDFSGTFFINTERDDDYAGFVFGYQSSSRFYVVMWKQVTQSYWDTNPTRAQGYSGLSVKVVNSTTGPGEHLRNALWHTGNTPGQVRTLWHDPRHIGWKDFTAYRWRLSHRPKTGFIRVVMYEGKKIMADSGPIYDKTYAGGRLGLFVFSQEMVFFSDLKYECRDP

SEQ ID NO: 104 - DNA, 827 bp, Homo sapiens
  CDS (29)..(823)
ctgagatcaccggcgaaggagggccaccatgtacaggatgcaactcctgtcttgcattgcactaagtcttgcacttgtcacgaattctccaggtttgaaaggaaaacgtggagacagtggatcacctgcaacctggacaacgagaggctttgtcttcacccgacacagtcaaaccacagcaattccttcatgtccagaggggacagtgccactctacagtgggttttcttttctttttgtacaaggaaatcaacgagcccacggacaagaccttggaactcttggcagctgcctgcagcgatttaccacaatgccattcttattctgcaatgtcaatgatgtatgtaattttgcatctcgaaatgattattcatactggctgtcaacaccagctctgatgccaatgaacatggctcccattactggcagagcccttgagccttatataagcagatgcactgtttgtgaaggtcctgcgatcgccatagccgttcacagccaaaccactgacattcctccatgtcctcacggctggatttctctctggaaaggattttcattcatcatgttcacaagtgcaggttctgagggcaccgggcaagcactggcctcccctggctcctgcctggaagagttccgagccagcccatttctagaatgtcatggaagaggaacgtgcaactactattcaaattcctacagtttctggctggcttcattaaacccagaaagaatgttcagaaagcctattccatcaactgtgaaagctggggaattagaaaaaataataagtcgctgtcaggtgtgcatgaagaaaagacactgag

SEQ ID NO: 105 - protein, 265 aa, Homo sapiens
MYRMQLLSCIALSLALVTNSPGLKGKRGDSGSPATWTTRGFVFTRHSQTTAIPSCPEGTVPLYSGFSFLFVQGNQRAHGQDLGTLGSCLQRFTTMPFLFCNVNDVCNFASRNDYSYWLSTPALMPMNMAPITGRALEPYISRCTVCEGPAIAIAVHSQTTDIPPCPHGWISLWKGFSFIMFTSAGSEGTGQALASPGSCLEEFRASPFLECHGRGTCNYYSNSYSFWLASLNPERMFRKPIPSTVKAGELEKIISRCQVCMKKRH

SEQ ID NO: 106 - DNA, 19 bp, Artificial Sequence
  VEGF 121 target sequence
tcatcacgaagtggtgaag

SEQ ID NO: 107 - RNA, 21 nt, Artificial Sequence
  VEGF siRNA sense strand
ucaucacgaaguggugaaguu

SEQ ID NO: 108 - RNA, 21 nt, Artificial Sequence
  VEGF siRNA antisense strand
cuucaccacuucgugaugauu

SEQ ID NO: 109 - DNA, 21 bp, Artificial Sequence
  VEGF siRNA sense strand
ucaucacgaaguggugaagtt

SEQ ID NO: 110 - DNA, 21 bp, Artificial Sequence
  VEGF siRNA antisense strand
cuucaccacuucgugaugatt

SEQ ID NO: 111 - DNA, 19 bp, Artificial Sequence
  VEGF target sequence
gttcatggatgtctatcag

SEQ ID NO: 112 - DNA, 19 bp, Artificial Sequence
  VEGF target sequence
tccctgtgggccttgctca

SEQ ID NO: 113 - DNA, 19 bp, Artificial Sequence
  VEGF target sequence
tcgagaccctggtggacat

SEQ ID NO: 114 - DNA, 19 bp, Artificial Sequence
  VEGF target sequence
gcatttgtttgtacaagat

SEQ ID NO: 115 - DNA, 19 bp, Artificial Sequence
  VEGF target sequence
tgacgagggcctggagtgt

SEQ ID NO: 116 - DNA, 19 bp, Artificial Sequence
  VEGF target sequence
gatccgcagacgtgtaaat

SEQ ID NO: 117 - DNA, 19 bp, Artificial Sequence
  VEGF target sequence
tgacgagggcctggagtgt

SEQ ID NO: 118 - DNA, 19 bp, Artificial Sequence
  VEGF target sequence
atgttcctgcaaaaacaca

SEQ ID NO: 119 - DNA, 19 bp, Artificial Sequence
  VEGF target sequence
catcaccatgcagattatg

SEQ ID NO: 120 - DNA, 19 bp, Artificial Sequence
  VEGF target sequence
tgttcctgcaaaaacacag

SEQ ID NO: 121 - DNA, 19 bp, Artificial Sequence
  VEGF target sequence
acctcaccaaggccagcac

SEQ ID NO: 122 - DNA, 19 bp, Artificial Sequence
  VEGF target sequence
aaacacagactcgcgttgc

SEQ ID NO: 123 - DNA, 19 bp, Artificial Sequence
  VEGF target sequence
ggccagcacataggagaga

SEQ ID NO: 124 - DNA, 19 bp, Artificial Sequence
  VEGF target sequence
aacacagactcgcgttgca

SEQ ID NO: 125 - DNA, 19 bp, Artificial Sequence
  VEGF target sequence
caaatgtgaatgcagacca

SEQ ID NO: 126 - DNA, 19 bp, Artificial Sequence
  VEGF target sequence
acacagactcgcgttgcaa

SEQ ID NO: 127 - DNA, 19 bp, Artificial Sequence
  VEGF target sequence
atgtgaatgcagaccaaag

SEQ ID NO: 128 - DNA, 19 bp, Artificial Sequence
  VEGF target sequence
cacagactcgcgttgcaag

SEQ ID NO: 129 - DNA, 19 bp, Artificial Sequence
  VEGF target sequence
tgcagaccaaagaaagata

SEQ ID NO: 130 - DNA, 19 bp, Artificial Sequence
  VEGF target sequence
ggcgaggcagcttgagtta

SEQ ID NO: 131 - DNA, 19 bp, Artificial Sequence
  VEGF target sequence
agaaagatagagcaagaca

SEQ ID NO: 132 - DNA, 19 bp, Artificial Sequence
  VEGF target sequence
acgaacgtacttgcagatg

SEQ ID NO: 133 - DNA, 19 bp, Artificial Sequence
  VEGF target sequence
gaaagatagagcaagacaa

SEQ ID NO: 134 - DNA, 19 bp, Artificial Sequence
  VEGF target sequence
cgaacgtacttgcagatgt

SEQ ID NO: 135 - DNA, 19 bp, Artificial Sequence
  VEGF target sequence
gatagagcaagacaagaaa

SEQ ID NO: 136 - DNA, 19 bp, Artificial Sequence
  VEGF target sequence
cgtacttgcagatgtgaca

SEQ ID NO: 137 - DNA, 19 bp, Artificial Sequence
  VEGF target sequence
gacaagaaaatccctgtgg

SEQ ID NO: 138 - DNA, 19 bp, Artificial Sequence
  VEGF target sequence
gtggtcccaggctgcaccc

SEQ ID NO: 139 - DNA, 19 bp, Artificial Sequence
  VEGF target sequence
gaaaatccctgtgggcctt

SEQ ID NO: 140 - DNA, 19 bp, Artificial Sequence
  VEGF target sequence
ggaggagggcagaatcatc

SEQ ID NO: 141 - DNA, 19 bp, Artificial Sequence
  VEGF target sequence
aatccctgtgggccttgct

SEQ ID NO: 142 - DNA, 19 bp, Artificial Sequence
  VEGF target sequence
gtggtgaagttcatggatg

SEQ ID NO: 143 - DNA, 21 bp, Artificial Sequence
  VEGF target sequence
aatcatcacgaagtggtgaag

SEQ ID NO: 144 - DNA, 23 bp, Artificial Sequence
  VEGF target sequence
aagcatttgtttgtacaagatcc

SEQ ID NO: 145 - DNA, 21 bp, Artificial Sequence
  VEGF target sequence
aagttcatggatgtctatcag

SEQ ID NO: 146 - DNA, 23 bp, Artificial Sequence
  VEGF target sequence
aagatccgcagacgtgtaaatgt

SEQ ID NO: 147 - DNA, 21 bp, Artificial Sequence
  VEGF target sequence
aatcgagaccctggtggacat

SEQ ID NO: 148 - DNA, 23 bp, Artificial Sequence
  VEGF target sequence
aaatgttcctgcaaaaacacaga

SEQ ID NO: 149 - DNA, 21 bp, Artificial Sequence
  VEGF target sequence
aatgacgagggcctggagtgt

SEQ ID NO: 150 - DNA, 23 bp, Artificial Sequence
  VEGF target sequence
aatgttcctgcaaaaacacagac

SEQ ID NO: 151 - DNA, 21 bp, Artificial Sequence
  VEGF target sequence
aacatcaccatgcagattatg

SEQ ID NO: 152 - DNA, 23 bp, Artificial Sequence
  VEGF target sequence
aaaaacacagactcgcgttgcaa

SEQ ID NO: 153 - DNA, 21 bp, Artificial Sequence
  VEGF target sequence
aaacctcaccaaggccagcac

SEQ ID NO: 154 - DNA, 23 bp, Artificial Sequence
  VEGF target sequence
aaaacacagactcgcgttgcaag

SEQ ID NO: 155 - DNA, 21 bp, Artificial Sequence
  VEGF target sequence
aaggccagcacataggagaga

SEQ ID NO: 156 - DNA, 23 bp, Artificial Sequence
  VEGF target sequence
aaacacagactcgcgttgcaagg

SEQ ID NO: 157 - DNA, 21 bp, Artificial Sequence
  VEGF target sequence
aacaaatgtgaatgcagacca

SEQ ID NO: 158 - DNA, 23 bp, Artificial Sequence
  VEGF target sequence
aacacagactcgcgttgcaaggc

SEQ ID NO: 159 - DNA, 21 bp, Artificial Sequence
  VEGF target sequence
aaatgtgaatgcagaccaaag

SEQ ID NO: 160 - DNA, 23 bp, Artificial Sequence
  VEGF target sequence
aaggcgaggcagcttgagttaaa

SEQ ID NO: 161 - DNA, 21 bp, Artificial Sequence
  VEGF target sequence
aatgcagaccaaagaaagata

SEQ ID NO: 162 - DNA, 23 bp, Artificial Sequence
  VEGF target sequence
aaacgaacgtacttgcagatgtg

SEQ ID NO: 163 - DNA, 21 bp, Artificial Sequence
  VEGF target sequence
aaagaaagatagagcaagaca

SEQ ID NO: 164 - DNA, 23 bp, Artificial Sequence
  VEGF target sequence
aacgaacgtacttgcagatgtga

SEQ ID NO: 165 - DNA, 21 bp, Artificial Sequence
  VEGF target sequence
aagaaagatagagcaagacaa

SEQ ID NO: 166 - DNA, 23 bp, Artificial Sequence
  VEGF target sequence
aagtggtcccaggctgcacccat

SEQ ID NO: 167 - DNA, 23 bp, Artificial Sequence
  VEGF target sequence
aagatagagcaagacaagaaaat

SEQ ID NO: 168 - DNA, 23 bp, Artificial Sequence
  VEGF target sequence
aaggaggagggcagaatcatcac

SEQ ID NO: 169 - DNA, 23 bp, Artificial Sequence
  VEGF target sequence
aagacaagaaaatccctgtgggc

SEQ ID NO: 170 - DNA, 23 bp, Artificial Sequence
  VEGF target sequence
aagtggtgaagttcatggatgtc

SEQ ID NO: 171 - DNA, 23 bp, Artificial Sequence
  VEGF target sequence
aagaaaatccctgtgggccttgc

SEQ ID NO: 172 - DNA, 23 bp, Artificial Sequence
  VEGF target sequence
aaaatccctgtgggccttgctca

SEQ ID NO: 173 - DNA, 23 bp, Artificial Sequence
  VEGF target sequence
aatccctgtgggccttgctcaga

SEQ ID NO: 174 - DNA, 21 bp, Artificial Sequence
  VEGF target sequence
ggcagaatcatcacgaagtgg

SEQ ID NO: 175 - DNA, 21 bp, Artificial Sequence
  VEGF target sequence
cctggtggacatcttccagga

SEQ ID NO: 176 - DNA, 21 bp, Artificial Sequence
  VEGF target sequence
cacacactcgcgttgcaaggc

SEQ ID NO: 177 - DNA, 21 bp, Artificial Sequence
  VEGF target sequence
gagatcgagtacatcttcaag

SEQ ID NO: 178 - DNA, 21 bp, Artificial Sequence
  VEGF target sequence
tcaccatgcagattatgcgga

SEQ ID NO: 179 - DNA, 21 bp, Artificial Sequence
  VEGF target sequence
tggagtgtgtgcccactgagg

SEQ ID NO: 180 - DNA, 21 bp, Artificial Sequence
  VEGF target sequence
tagagcaagacaagaaaatcc

SEQ ID NO: 181 - DNA, 21 bp, Artificial Sequence
  VEGF target sequence
gagcttcctacagcacaacaa

SEQ ID NO: 182 - DNA, 21 bp, Artificial Sequence
  VEGF target sequence
ccgcagacgtgtaaatgttcc

SEQ ID NO: 183 - DNA, 21 bp, Artificial Sequence
  VEGF target sequence
ttgctcagagcggagaaagca

SEQ ID NO: 184 - DNA, 21 bp, Artificial Sequence
  HIF-1 alpha target sequence
aactaactggacacagtgtgt

SEQ ID NO: 185 - DNA, 17 bp, Artificial Sequence
  HIF-1 alpha target sequence
cgacaagaaaaagataa

SEQ ID NO: 186 - DNA, 17 bp, Artificial Sequence
  HIF-1 alpha target sequence
aaagataagttctgaac

SEQ ID NO: 187 - DNA, 17 bp, Artificial Sequence
  HIF-1 alpha target sequence
agataagttctgaacgt

SEQ ID NO: 188 - DNA, 17 bp, Artificial Sequence
  HIF-1 alpha target sequence
gttctgaacgtcgaaaa

SEQ ID NO: 189 - DNA, 17 bp, Artificial Sequence
  HIF-1 alpha target sequence
aagaaaagtctcgagat

SEQ ID NO: 190 - DNA, 17 bp, Artificial Sequence
  HIF-1 alpha target sequence
gaaaagtctcgagatgc

SEQ ID NO: 191 - DNA, 17 bp, Artificial Sequence
  HIF-1 alpha target sequence
agtctcgagatgcagcc

SEQ ID NO: 192 - DNA, 17 bp, Artificial Sequence
  HIF-1 alpha target sequence
gtaaagaatctgaagtt

SEQ ID NO: 193 - DNA, 17 bp, Artificial Sequence
  HIF-1 alpha target sequence
gaatctgaagtttttta

SEQ ID NO: 194 - DNA, 17 bp, Artificial Sequence
  HIF-1 alpha target sequence
gttttttatgagcttgc

SEQ ID NO: 195 - DNA, 17 bp, Artificial Sequence
  HIF-1 alpha target sequence
ggcctctgtgatgaggc

SEQ ID NO: 196 - DNA, 17 bp, Artificial Sequence
  HIF-1 alpha target sequence
cttctggatgctggtga

SEQ ID NO: 197 - DNA, 17 bp, Artificial Sequence
  HIF-1 alpha target sequence
agcacagatgaattgct

SEQ ID NO: 198 - DNA, 21 bp, Artificial Sequence
  HIF-1 alpha target sequence
aaatgcttacacacagaaatg

SEQ ID NO: 199 - DNA, 17 bp, Artificial Sequence
  HIF-1 alpha target sequence
gaaaaagataagttctg

SEQ ID NO: 200 - DNA, 21 bp, Artificial Sequence
  HIF-1 target sequence
aagttttttatgagcttgctc

SEQ ID NO: 201 - DNA, 21 bp, Artificial Sequence
  HIF-1 target sequence
aagttttttatgagcttgctc

SEQ ID NO: 202 - DNA, 21 bp, Artificial Sequence
  HIF-1 target sequence
aaggcctctgtgatgaggctt

SEQ ID NO: 203 - DNA, 21 bp, Artificial Sequence
  HIF-1 target sequence
aaacttctggatgctggtgat

SEQ ID NO: 204 - DNA, 21 bp, Artificial Sequence
  HIF-1 target sequence
aacttctggatgctggtgatt

SEQ ID NO: 205 - DNA, 21 bp, Artificial Sequence
  HIF-1 target sequence
aagatgacatgaaagcacaga

SEQ ID NO: 206 - DNA, 21 bp, Artificial Sequence
  HIF-1 target sequence
aaagcacagatgaattgcttt

SEQ ID NO: 207 - DNA, 21 bp, Artificial Sequence
  HIF-1 target sequence
aagcacagatgaattgctttt

SEQ ID NO: 208 - DNA, 21 bp, Artificial Sequence
  HIF-1 target sequence
aattgcttttatttgaaagcc

SEQ ID NO: 209 - DNA, 21 bp, Artificial Sequence
  HIF-1 target sequence
aaagccttggatggttttgtt

SEQ ID NO: 210 - DNA, 21 bp, Artificial Sequence
  HIF-1 target sequence
aagccttggatggttttgtta

SEQ ID NO: 211 - DNA, 21 bp, Artificial Sequence
  HIF-1 target sequence
aatgtgaacaaatacatggga

SEQ ID NO: 212 - DNA, 21 bp, Artificial Sequence
  HIF-1 target sequence
aacaaatacatgggattaact

SEQ ID NO: 213 - DNA, 21 bp, Artificial Sequence
  HIF-1 target sequence
aaatacatgggattaactcag

SEQ ID NO: 214 - DNA, 21 bp, Artificial Sequence
  HIF-1 target sequence
aaatacatgggattaactcag

SEQ ID NO: 215 - DNA, 21 bp, Artificial Sequence
  HIF-1 target sequence
aactcagtttgaactaactgg

SEQ ID NO: 216 - DNA, 21 bp, Artificial Sequence
  HIF-1 target sequence
aactaactggacacagtgtgt

SEQ ID NO: 217 - DNA, 21 bp, Artificial Sequence
  HIF-1 target sequence
aactggacacagtgtgtttga

SEQ ID NO: 218 - DNA, 21 bp, Artificial Sequence
  HIF-1 target sequence
aaatgagagaaatgcttacac

SEQ ID NO: 219 - DNA, 21 bp, Artificial Sequence
  HIF-1 target sequence
aatgagagaaatgcttacaca

SEQ ID NO: 220 - DNA, 21 bp, Artificial Sequence
  HIF-1 target sequence
aaatgcttacacacagaaatg

SEQ ID NO: 221 - DNA, 21 bp, Artificial Sequence
  HIF-1 target sequence
aatgcttacacacagaaatgg

SEQ ID NO: 222 - DNA, 21 bp, Artificial Sequence
  HIF-1 target sequence
aaatggccttgtgaaaaaggg

SEQ ID NO: 223 - DNA, 21 bp, Artificial Sequence
  HIF-1 target sequence
aatggccttgtgaaaaagggt

SEQ ID NO: 224 - DNA, 21 bp, Artificial Sequence
  HIF-1 target sequence
aaaaagggtaaagaacaaaac

SEQ ID NO: 225 - DNA, 21 bp, Artificial Sequence
  HIF-1 target sequence
aaaagggtaaagaacaaaaca

SEQ ID NO: 226 - DNA, 21 bp, Artificial Sequence
  HIF-1 target sequence
aaagggtaaagaacaaaacac

SEQ ID NO: 227 - DNA, 21 bp, Artificial Sequence
  HIF-1 target sequence
aagggtaaagaacaaaacaca

SEQ ID NO: 228 - DNA, 21 bp, Artificial Sequence
  HIF-1 target sequence
aaagaacaaaacacacagcga

SEQ ID NO: 229 - DNA, 21 bp, Artificial Sequence
  HIF-1 target sequence
aagaacaaaacacacagcgaa

SEQ ID NO: 230 - DNA, 21 bp, Artificial Sequence
  HIF-1 target sequence
aacaaaacacacagcgaagct

SEQ ID NO: 231 - DNA, 21 bp, Artificial Sequence
  HIF-1 target sequence
aacaaaacacacagcgaagct

SEQ ID NO: 232 - DNA, 21 bp, Artificial Sequence
  HIF-1 target sequence
aaacacacagcgaagcttttt

SEQ ID NO: 233 - DNA, 21 bp, Artificial Sequence
  HIF-1 target sequence
aacacacagcgaagctttttt

SEQ ID NO: 234 - DNA, 21 bp, Artificial Sequence
  HIF-1 target sequence
aagcttttttctcagaatgaa

SEQ ID NO: 235 - DNA, 21 bp, Artificial Sequence
  HIF-1 target sequence
aatgaagtgtaccctaactag

SEQ ID NO: 236 - DNA, 21 bp, Artificial Sequence
  HIF-1 target sequence
aagtgtaccctaactagccga

SEQ ID NO: 237 - DNA, 21 bp, Artificial Sequence
  HIF-1 target sequence
aactagccgaggaagaactat

SEQ ID NO: 238 - DNA, 21 bp, Artificial Sequence
  HIF-1 target sequence
aagaactatgaacataaagtc

SEQ ID NO: 239 - DNA, 21 bp, Artificial Sequence
  HIF-1 target sequence
aactatgaacataaagtctgc

SEQ ID NO: 240 - DNA, 21 bp, Artificial Sequence
  HIF-1 target sequence
aacataaagtctgcaacatgg

SEQ ID NO: 241 - DNA, 21 bp, Artificial Sequence
  HIF-1 target sequence
aaagtctgcaacatggaaggt

SEQ ID NO: 242 - DNA, 21 bp, Artificial Sequence
  HIF-1 target sequence
aagtctgcaacatggaaggta

SEQ ID NO: 243 - DNA, 21 bp, Artificial Sequence
  HIF-1 target sequence
aacatggaaggtattgcactg

SEQ ID NO: 244 - DNA, 21 bp, Artificial Sequence
  HIF-1 target sequence
aaggtattgcactgcacaggc

SEQ ID NO: 245 - DNA, 21 bp, Artificial Sequence
  HIF-1 target sequence
aacagtaaccaacctcagtgt

SEQ ID NO: 246 - DNA, 21 bp, Artificial Sequence
  HIF-1 target sequence
aaccaacctcagtgtgggtat

SEQ ID NO: 247 - DNA, 21 bp, Artificial Sequence
  HIF-1 target sequence
aacctcagtgtgggtataaga

SEQ ID NO: 248 - DNA, 21 bp, Artificial Sequence
  HIF-1 target sequence
aagaaaccacctatgacctgc

SEQ ID NO: 249 - DNA, 21 bp, Artificial Sequence
  HIF-1 target sequence
aagaaaccacctatgacctgc

SEQ ID NO: 250 - DNA, 21 bp, Artificial Sequence
  HIF-1 target sequence
aaccacctatgacctgcttgg

SEQ ID NO: 251 - DNA, 21 bp, Artificial Sequence
  HIF-1 target sequence
aacccattcctcacccatcaa

SEQ ID NO: 252 - DNA, 21 bp, Artificial Sequence
  HIF-1 target sequence
aaatattgaaattcctttaga

SEQ ID NO: 253 - DNA, 21 bp, Artificial Sequence
  HIF-1 target sequence
aatattgaaattcctttagat

SEQ ID NO: 254 - DNA, 21 bp, Artificial Sequence
  HIF-1 target sequence
aaattcctttagatagcaaga

SEQ ID NO: 255 - DNA, 21 bp, Artificial Sequence
  HIF-1 target sequence
aattcctttagatagcaagac

SEQ ID NO: 256 - DNA, 21 bp, Artificial Sequence
  HIF-1 target sequence
aagactttcctcagtcgacac

SEQ ID NO: 257 - DNA, 21 bp, Artificial Sequence
  HIF-1 target sequence
aaattttcttattgtgatgaa

SEQ ID NO: 258 - DNA, 21 bp, Artificial Sequence
  HIF-1 target sequence
aattttcttattgtgatgaaa

SEQ ID NO: 259 - DNA, 21 bp, Artificial Sequence
  HIF-1 target sequence
aaagaattaccgaattgatgg

SEQ ID NO: 260 - DNA, 21 bp, Artificial Sequence
  HIF-1 target sequence
aattaccgaattgatgggata

SEQ ID NO: 261 - DNA, 21 bp, Artificial Sequence
  HIF-1 target sequence
aattaccgaattgatgggata

SEQ ID NO: 262 - DNA, 21 bp, Artificial Sequence
  HIF-1 target sequence
aagaacttttaggccgctcaa

SEQ ID NO: 263 - DNA, 21 bp, Artificial Sequence
  HIF-1 target sequence
aacttttaggccgctcaattt

SEQ ID NO: 264 - DNA, 21 bp, Artificial Sequence
  HIF-1 target sequence
aatttatgaatattatcatgc

SEQ ID NO: 265 - DNA, 21 bp, Artificial Sequence
  HIF-1 target sequence
aatattatcatgctttggact

SEQ ID NO: 266 - DNA, 21 bp, Artificial Sequence
  HIF-1 target sequence
aaaactcatcatgatatgttt

SEQ ID NO: 267 - DNA, 21 bp, Artificial Sequence
  HIF-1 target sequence
aaactcatcatgatatgttta

SEQ ID NO: 268 - DNA, 21 bp, Artificial Sequence
  HIF-1 target sequence
aactcatcatgatatgtttac

SEQ ID NO: 269 - DNA, 21 bp, Artificial Sequence
  HIF-1 target sequence
aaaggacaagtcaccacagga

SEQ ID NO: 270 - DNA, 21 bp, Artificial Sequence
  HIF-1 target sequence
aaggacaagtcaccacaggac

SEQ ID NO: 271 - DNA, 21 bp, Artificial Sequence
  HIF-1 target sequence
aagtcaccacaggacagtaca

SEQ ID NO: 272 - DNA, 21 bp, Artificial Sequence
  HIF-1 target sequence
aaaagaggtggatatgtctgg

SEQ ID NO: 273 - DNA, 21 bp, Artificial Sequence
  HIF-1 target sequence
aaagaggtggatatgtctggg

SEQ ID NO: 274 - DNA, 21 bp, Artificial Sequence
  HIF-1 target sequence
aagaggtggatatgtctgggt

SEQ ID NO: 275 - DNA, 21 bp, Artificial Sequence
  HIF-1 target sequence
aaactcaagcaactgtcatat

SEQ ID NO: 276 - DNA, 21 bp, Artificial Sequence
  HIF-1 target sequence
aactcaagcaactgtcatata

SEQ ID NO: 277 - DNA, 21 bp, Artificial Sequence
  HIF-1 target sequence
aagcaactgtcatatataaca

SEQ ID NO: 278 - DNA, 21 bp, Artificial Sequence
  HIF-1 target sequence
aactgtcatatataacaccaa

SEQ ID NO: 279 - DNA, 21 bp, Artificial Sequence
  HIF-1 target sequence
aacaccaagaattctcaacca

SEQ ID NO: 280 - DNA, 21 bp, Artificial Sequence
  HIF-1 target sequence
aagaattctcaaccacagtgc

SEQ ID NO: 281 - DNA, 21 bp, Artificial Sequence
  HIF-1 target sequence
aattctcaaccacagtgcatt

SEQ ID NO: 282 - DNA, 21 bp, Artificial Sequence
  HIF-1 target sequence
aaccacagtgcattgtatgtg

SEQ ID NO: 283 - DNA, 21 bp, Artificial Sequence
  HIF-1 target sequence
aattacgttgtgagtggtatt

SEQ ID NO: 284 - DNA, 21 bp, Artificial Sequence
  HIF-1 target sequence
aacaaacagaatgtgtcctta

SEQ ID NO: 285 - DNA, 21 bp, Artificial Sequence
  HIF-1 target sequence
aaacagaatgtgtccttaaac

SEQ ID NO: 286 - DNA, 21 bp, Artificial Sequence
  HIF-1 target sequence
aacagaatgtgtccttaaacc

SEQ ID NO: 287 - DNA, 20 bp, Artificial Sequence
  HIF-1 target sequence
atgtgtccttaaaccggttg

SEQ ID NO: 288 - DNA, 21 bp, Artificial Sequence
  HIF-1 target sequence
aaaccggttgaatcttcagat

SEQ ID NO: 289 - DNA, 21 bp, Artificial Sequence
  HIF-1 target sequence
aaccggttgaatcttcagata

SEQ ID NO: 290 - DNA, 21 bp, Artificial Sequence
  HIF-1 target sequence
aatcttcagatatgaaaatga

SEQ ID NO: 291 - DNA, 21 bp, Artificial Sequence
  HIF-1 target sequence
aaaatgactcagctattcacc

SEQ ID NO: 292 - DNA, 21 bp, Artificial Sequence
  HIF-1 target sequence
aaatgactcagctattcacca

SEQ ID NO: 293 - DNA, 21 bp, Artificial Sequence
  HIF-1 target sequence
aatgactcagctattcaccaa

SEQ ID NO: 294 - DNA, 21 bp, Artificial Sequence
  HIF-1 target sequence
aaagttgaatcagaagataca

SEQ ID NO: 295 - DNA, 21 bp, Artificial Sequence
  HIF-1 target sequence
aagttgaatcagaagatacaa

SEQ ID NO: 296 - DNA, 21 bp, Artificial Sequence
  HIF-1 target sequence
aatcagaagatacaagtagcc

SEQ ID NO: 297 - DNA, 21 bp, Artificial Sequence
  HIF-1 target sequence
aagatacaagtagcctctttg

SEQ ID NO: 298 - DNA, 21 bp, Artificial Sequence
  HIF-1 target sequence
aagtagcctctttgacaaact

SEQ ID NO: 299 - DNA, 21 bp, Artificial Sequence
  HIF-1 target sequence
aaacttaagaaggaacctgat

SEQ ID NO: 300 - DNA, 21 bp, Artificial Sequence
  HIF-1 target sequence
aacttaagaaggaacctgatg

SEQ ID NO: 301 - DNA, 21 bp, Artificial Sequence
  HIF-1 target sequence
aagaaggaacctgatgcttta

SEQ ID NO: 302 - DNA, 21 bp, Artificial Sequence
  HIF-1 target sequence
aaggaacctgatgctttaact

SEQ ID NO: 303 - DNA, 21 bp, Artificial Sequence
  HIF-1 target sequence
aacctgatgctttaactttgc

SEQ ID NO: 304 - DNA, 21 bp, Artificial Sequence
  HIF-1 target sequence
aactttgctggccccagccgc

SEQ ID NO: 305 - DNA, 21 bp, Artificial Sequence
  HIF-1 target sequence
aatcatatctttagattttgg

SEQ ID NO: 306 - DNA, 21 bp, Artificial Sequence
  HIF-1 target sequence
aacgacacagaaactgatgac

SEQ ID NO: 307 - DNA, 21 bp, Artificial Sequence
  HIF-1 target sequence
aaactgatgaccagcaacttg

SEQ ID NO: 308 - DNA, 21 bp, Artificial Sequence
  HIF-1 target sequence
aactgatgaccagcaacttga

SEQ ID NO: 309 - DNA, 21 bp, Artificial Sequence
  HIF-1 target sequence
aacttgaggaagtaccattat

SEQ ID NO: 310 - DNA, 21 bp, Artificial Sequence
  HIF-1 target sequence
aagtaccattatataatgatg

SEQ ID NO: 311 - DNA, 21 bp, Artificial Sequence
  HIF-1 target sequence
aatgatgtaatgctcccctca

SEQ ID NO: 312 - DNA, 21 bp, Artificial Sequence
  HIF-1 target sequence
aatgctcccctcacccaacga

SEQ ID NO: 313 - DNA, 21 bp, Artificial Sequence
  HIF-1 target sequence
aacgaaaaattacagaatata

SEQ ID NO: 314 - DNA, 21 bp, Artificial Sequence
  HIF-1 target sequence
aaaaattacagaatataaatt

SEQ ID NO: 315 - DNA, 21 bp, Artificial Sequence
  HIF-1 target sequence
aaaattacagaatataaattt

SEQ ID NO: 316 - DNA, 21 bp, Artificial Sequence
  HIF-1 target sequence
aaattacagaatataaatttg

SEQ ID NO: 317 - DNA, 21 bp, Artificial Sequence
  HIF-1 target sequence
aattacagaatataaatttgg

SEQ ID NO: 318 - DNA, 21 bp, Artificial Sequence
  HIF-1 target sequence
aatataaatttggcaatgtct

SEQ ID NO: 319 - DNA, 21 bp, Artificial Sequence
  HIF-1 target sequence
aaatttggcaatgtctccatt

SEQ ID NO: 320 - DNA, 21 bp, Artificial Sequence
  HIF-1 target sequence
aatttggcaatgtctccatta

SEQ ID NO: 321 - DNA, 21 bp, Artificial Sequence
  HIF-1 target sequence
aatgtctccattacccaccgc

SEQ ID NO: 322 - DNA, 21 bp, Artificial Sequence
  HIF-1 target sequence
aaacgccaaagccacttcgaa

SEQ ID NO: 323 - DNA, 21 bp, Artificial Sequence
  HIF-1 target sequence
aacgccaaagccacttcgaag

SEQ ID NO: 324 - DNA, 21 bp, Artificial Sequence
  HIF-1 target sequence
aaagccacttcgaagtagtgc

SEQ ID NO: 325 - DNA, 21 bp, Artificial Sequence
  HIF-1 target sequence
aagccacttcgaagtagtgct

SEQ ID NO: 326 - DNA, 21 bp, Artificial Sequence
  HIF-1 target sequence
aagtagtgctgaccctgcact

SEQ ID NO: 327 - DNA, 21 bp, Artificial Sequence
  HIF-1 target sequence
aatcaagaagttgcattaaaa

SEQ ID NO: 328 - DNA, 21 bp, Artificial Sequence
  HIF-1 target sequence
aagaagttgcattaaaattag

SEQ ID NO: 329 - DNA, 21 bp, Artificial Sequence
  HIF-1 target sequence
aagttgcattaaaattagaac

SEQ ID NO: 330 - DNA, 21 bp, Artificial Sequence
  HIF-1 target sequence
aaaattagaaccaaatccaga

SEQ ID NO: 331 - DNA, 21 bp, Artificial Sequence
  HIF-1 target sequence
aaattagaaccaaatccagag

SEQ ID NO: 332 - DNA, 21 bp, Artificial Sequence
  HIF-1 target sequence
aattagaaccaaatccagagt

SEQ ID NO: 333 - DNA, 21 bp, Artificial Sequence
  HIF-1 target sequence
aaccaaatccagagtcactgg

SEQ ID NO: 334 - DNA, 21 bp, Artificial Sequence
  HIF-1 target sequence
aaatccagagtcactggaact

SEQ ID NO: 335 - DNA, 21 bp, Artificial Sequence
  HIF-1 target sequence
aatccagagtcactggaactt

SEQ ID NO: 336 - DNA, 21 bp, Artificial Sequence
  HIF-1 target sequence
aactttcttttaccatgcccc

SEQ ID NO: 337 - DNA, 21 bp, Artificial Sequence
  HIF-1 target sequence
aagcactagacaaagttcacc

SEQ ID NO: 338 - DNA, 21 bp, Artificial Sequence
  HIF-1 target sequence
aaagttcacctgagcctaata

SEQ ID NO: 339 - DNA, 21 bp, Artificial Sequence
  HIF-1 target sequence
aagttcacctgagcctaatag

SEQ ID NO: 340 - DNA, 21 bp, Artificial Sequence
  HIF-1 target sequence
aatagtcccagtgaatattgt

SEQ ID NO: 341 - DNA, 21 bp, Artificial Sequence
  HIF-1 target sequence
aatattgtttttatgtggata

SEQ ID NO: 342 - DNA, 21 bp, Artificial Sequence
  HIF-1 target sequence
aatgaattcaagttggaattg

SEQ ID NO: 343 - DNA, 21 bp, Artificial Sequence
  HIF-1 target sequence
aattcaagttggaattggtag

SEQ ID NO: 344 - DNA, 21 bp, Artificial Sequence
  HIF-1 target sequence
aagttggaattggtagaaaaa

SEQ ID NO: 345 - DNA, 21 bp, Artificial Sequence
  HIF-1 target sequence
aattggtagaaaaactttttg

SEQ ID NO: 346 - DNA, 21 bp, Artificial Sequence
  HIF-1 target sequence
aaaactttttgctgaagacac

SEQ ID NO: 347 - DNA, 21 bp, Artificial Sequence
  HIF-1 target sequence
aaactttttgctgaagacaca

SEQ ID NO: 348 - DNA, 21 bp, Artificial Sequence
  HIF-1 target sequence
aactttttgctgaagacacag

SEQ ID NO: 349 - DNA, 21 bp, Artificial Sequence
  HIF-1 target sequence
aagacacagaagcaaagaacc

SEQ ID NO: 350 - DNA, 21 bp, Artificial Sequence
  HIF-1 target sequence
aagcaaagaacccattttcta

SEQ ID NO: 351 - DNA, 21 bp, Artificial Sequence
  HIF-1 target sequence
aaagaacccattttctactca

SEQ ID NO: 352 - DNA, 21 bp, Artificial Sequence
  HIF-1 target sequence
aagaacccattttctactcag

SEQ ID NO: 353 - DNA, 21 bp, Artificial Sequence
  HIF-1 target sequence
aacccattttctactcaggac

SEQ ID NO: 354 - DNA, 21 bp, Artificial Sequence
  HIF-1 target sequence
aatggatgatgacttccagtt

SEQ ID NO: 355 - DNA, 21 bp, Artificial Sequence
  HIF-1 target sequence
aaagcagttccgcaagccctg

SEQ ID NO: 356 - DNA, 21 bp, Artificial Sequence
  HIF-1 target sequence
aagcagttccgcaagccctga

SEQ ID NO: 357 - DNA, 21 bp, Artificial Sequence
  HIF-1 target sequence
aagccctgaaagcgcaagtcc

SEQ ID NO: 358 - DNA, 21 bp, Artificial Sequence
  HIF-1 target sequence
aaagcgcaagtcctcaaagca

SEQ ID NO: 359 - DNA, 21 bp, Artificial Sequence
  HIF-1 target sequence
aagcgcaagtcctcaaagcac

SEQ ID NO: 360 - DNA, 21 bp, Artificial Sequence
  HIF-1 target sequence
aagtcctcaaagcacagttac

SEQ ID NO: 361 - DNA, 21 bp, Artificial Sequence
  HIF-1 target sequence
aaagcacagttacagtattcc

SEQ ID NO: 362 - DNA, 21 bp, Artificial Sequence
  HIF-1 target sequence
aagcacagttacagtattcca

SEQ ID NO: 363 - DNA, 21 bp, Artificial Sequence
  HIF-1 target sequence
aaatacaagaacctactgcta

SEQ ID NO: 364 - DNA, 21 bp, Artificial Sequence
  HIF-1 target sequence
aatacaagaacctactgctaa

SEQ ID NO: 365 - DNA, 21 bp, Artificial Sequence
  HIF-1 target sequence
aagaacctactgctaatgcca

SEQ ID NO: 366 - DNA, 21 bp, Artificial Sequence
  HIF-1 target sequence
aacctactgctaatgccacca

SEQ ID NO: 367 - DNA, 21 bp, Artificial Sequence
  HIF-1 target sequence
aatgccaccactaccactgcc

SEQ ID NO: 368 - DNA, 21 bp, Artificial Sequence
  HIF-1 target sequence
aattaaaaacagtgacaaaag

SEQ ID NO: 369 - DNA, 21 bp, Artificial Sequence
  HIF-1 target sequence
aaaaacagtgacaaaagaccg

SEQ ID NO: 370 - DNA, 21 bp, Artificial Sequence
  HIF-1 target sequence
aaaacagtgacaaaagaccgt

SEQ ID NO: 371 - DNA, 21 bp, Artificial Sequence
  HIF-1 target sequence
aaacagtgacaaaagaccgta

SEQ ID NO: 372 - DNA, 21 bp, Artificial Sequence
  HIF-1 target sequence
aacagtgacaaaagaccgtat

SEQ ID NO: 373 - DNA, 21 bp, Artificial Sequence
  HIF-1 target sequence
aaaagaccgtatggaagacat

SEQ ID NO: 374 - DNA, 21 bp, Artificial Sequence
  HIF-1 target sequence
aaagaccgtatggaagacatt

SEQ ID NO: 375 - DNA, 21 bp, Artificial Sequence
  HIF-1 target sequence
aagaccgtatggaagacatta

SEQ ID NO: 376 - DNA, 21 bp, Artificial Sequence
  HIF-1 target sequence
aagacattaaaatattgattg

SEQ ID NO: 377 - DNA, 21 bp, Artificial Sequence
  HIF-1 target sequence
aaaatattgattgcatctcca

SEQ ID NO: 378 - DNA, 21 bp, Artificial Sequence
  HIF-1 target sequence
aaatattgattgcatctccat

SEQ ID NO: 379 - DNA, 21 bp, Artificial Sequence
  HIF-1 target sequence
aatattgattgcatctccatc

SEQ ID NO: 380 - DNA, 21 bp, Artificial Sequence
  HIF-1 target sequence
aaagaaactactagtgccaca

SEQ ID NO: 381 - DNA, 21 bp, Artificial Sequence
  HIF-1 target sequence
aagaaactactagtgccacat

SEQ ID NO: 382 - DNA, 21 bp, Artificial Sequence
  HIF-1 target sequence
aaactactagtgccacatcat

SEQ ID NO: 383 - DNA, 21 bp, Artificial Sequence
  HIF-1 target sequence
aactactagtgccacatcatc

SEQ ID NO: 384 - DNA, 21 bp, Artificial Sequence
  HIF-1 target sequence
aaagtcggacagcctcaccaa

SEQ ID NO: 385 - DNA, 21 bp, Artificial Sequence
  HIF-1 target sequence
aagtcggacagcctcaccaaa

SEQ ID NO: 386 - DNA, 21 bp, Artificial Sequence
  HIF-1 target sequence
aaacagagcaggaaaaggagt

SEQ ID NO: 387 - DNA, 21 bp, Artificial Sequence
  HIF-1 target sequence
aacagagcaggaaaaggagtc

SEQ ID NO: 388 - DNA, 21 bp, Artificial Sequence
  HIF-1 target sequence
aaaaggagtcatagaacagac

SEQ ID NO: 389 - DNA, 21 bp, Artificial Sequence
  HIF-1 target sequence
aaaggagtcatagaacagaca

SEQ ID NO: 390 - DNA, 21 bp, Artificial Sequence
  HIF-1 target sequence
aaggagtcatagaacagacag

SEQ ID NO: 391 - DNA, 21 bp, Artificial Sequence
  HIF-1 target sequence
aacagacagaaaaatctcatc

SEQ ID NO: 392 - DNA, 21 bp, Artificial Sequence
  HIF-1 target sequence
aaaaatctcatccaagaagcc

SEQ ID NO: 393 - DNA, 21 bp, Artificial Sequence
  HIF-1 target sequence
aaaatctcatccaagaagccc

SEQ ID NO: 394 - DNA, 21 bp, Artificial Sequence
  HIF-1 target sequence
aaatctcatccaagaagccct

SEQ ID NO: 395 - DNA, 21 bp, Artificial Sequence
  HIF-1 target sequence
aatctcatccaagaagcccta

SEQ ID NO: 396 - DNA, 21 bp, Artificial Sequence
  HIF-1 target sequence
aagaagccctaacgtgttatc

SEQ ID NO: 397 - DNA, 21 bp, Artificial Sequence
  HIF-1 target sequence
aagccctaacgtgttatctgt

SEQ ID NO: 398 - DNA, 21 bp, Artificial Sequence
  HIF-1 target sequence
aacgtgttatctgtcgctttg

SEQ ID NO: 399 - DNA, 21 bp, Artificial Sequence
  HIF-1 target sequence
aaagaactacagttcctgagg

SEQ ID NO: 400 - DNA, 21 bp, Artificial Sequence
  HIF-1 target sequence
aagaactacagttcctgagga

SEQ ID NO: 401 - DNA, 21 bp, Artificial Sequence
  HIF-1 target sequence
aactacagttcctgaggaaga

SEQ ID NO: 402 - DNA, 21 bp, Artificial Sequence
  HIF-1 target sequence
aagaactaaatccaaagatac

SEQ ID NO: 403 - DNA, 21 bp, Artificial Sequence
  HIF-1 target sequence
aactaaatccaaagatactag

SEQ ID NO: 404 - DNA, 21 bp, Artificial Sequence
  HIF-1 target sequence
aaatccaaagatactagcttt

SEQ ID NO: 405 - DNA, 21 bp, Artificial Sequence
  HIF-1 target sequence
aatccaaagatactagctttg

SEQ ID NO: 406 - DNA, 21 bp, Artificial Sequence
  HIF-1 target sequence
aaagatactagctttgcagaa

SEQ ID NO: 407 - DNA, 21 bp, Artificial Sequence
  HIF-1 target sequence
aagatactagctttgcagaat

SEQ ID NO: 408 - DNA, 21 bp, Artificial Sequence
  HIF-1 target sequence
aatgctcagagaaagcgaaaa

SEQ ID NO: 409 - DNA, 21 bp, Artificial Sequence
  HIF-1 target sequence
aaagcgaaaaatggaacatga

SEQ ID NO: 410 - DNA, 21 bp, Artificial Sequence
  HIF-1 target sequence
aagcgaaaaatggaacatgat

SEQ ID NO: 411 - DNA, 21 bp, Artificial Sequence
  HIF-1 target sequence
aaaaatggaacatgatggttc

SEQ ID NO: 412 - DNA, 21 bp, Artificial Sequence
  HIF-1 target sequence
aaaatggaacatgatggttca

SEQ ID NO: 413 - DNA, 21 bp, Artificial Sequence
  HIF-1 target sequence
aaatggaacatgatggttcac

SEQ ID NO: 414 - DNA, 21 bp, Artificial Sequence
  HIF-1 target sequence
aatggaacatgatggttcact

SEQ ID NO: 415 - DNA, 21 bp, Artificial Sequence
  HIF-1 target sequence
aacatgatggttcactttttc

SEQ ID NO: 416 - DNA, 21 bp, Artificial Sequence
  HIF-1 target sequence
aagcagtaggaattggaacat

SEQ ID NO: 417 - DNA, 21 bp, Artificial Sequence
  HIF-1 target sequence
aattggaacattattacagca

SEQ ID NO: 418 - DNA, 21 bp, Artificial Sequence
  HIF-1 target sequence
aacattattacagcagccaga

SEQ ID NO: 419 - DNA, 21 bp, Artificial Sequence
  HIF-1 target sequence
aaacgtgtaaaaggatgcaaa

SEQ ID NO: 420 - DNA, 21 bp, Artificial Sequence
  HIF-1 target sequence
aacgtgtaaaaggatgcaaat

SEQ ID NO: 421 - DNA, 21 bp, Artificial Sequence
  HIF-1 target sequence
aaaaggatgcaaatctagtga

SEQ ID NO: 422 - DNA, 21 bp, Artificial Sequence
  HIF-1 target sequence
aaaggatgcaaatctagtgaa

SEQ ID NO: 423 - DNA, 21 bp, Artificial Sequence
  HIF-1 target sequence
aaggatgcaaatctagtgaac

SEQ ID NO: 424 - DNA, 21 bp, Artificial Sequence
  HIF-1 target sequence
aaatctagtgaacagaatgga

SEQ ID NO: 425 - DNA, 21 bp, Artificial Sequence
  HIF-1 target sequence
aatctagtgaacagaatggaa

SEQ ID NO: 426 - DNA, 21 bp, Artificial Sequence
  HIF-1 target sequence
aacagaatggaatggagcaaa

SEQ ID NO: 427 - DNA, 21 bp, Artificial Sequence
  HIF-1 target sequence
aatggaatggagcaaaagaca

SEQ ID NO: 428 - DNA, 21 bp, Artificial Sequence
  HIF-1 target sequence
aatggagcaaaagacaattat

SEQ ID NO: 429 - DNA, 21 bp, Artificial Sequence
  HIF-1 target sequence
aaaagacaattattttaatac

SEQ ID NO: 430 - DNA, 21 bp, Artificial Sequence
  HIF-1 target sequence
aaagacaattattttaatacc

SEQ ID NO: 431 - DNA, 21 bp, Artificial Sequence
  HIF-1 target sequence
aagacaattattttaataccc

SEQ ID NO: 432 - DNA, 21 bp, Artificial Sequence
  HIF-1 target sequence
aattattttaataccctctga

SEQ ID NO: 433 - DNA, 21 bp, Artificial Sequence
  HIF-1 target sequence
aataccctctgatttagcatg

SEQ ID NO: 434 - DNA, 21 bp, Artificial Sequence
  HIF-1 target sequence
aatcaatggatgaaagtggat

SEQ ID NO: 435 - DNA, 21 bp, Artificial Sequence
  HIF-1 target sequence
aatggatgaaagtggattacc

SEQ ID NO: 436 - DNA, 21 bp, Artificial Sequence
  HIF-1 target sequence
aaagtggattaccacagctga

SEQ ID NO: 437 - DNA, 21 bp, Artificial Sequence
  HIF-1 target sequence
aagtggattaccacagctgac

SEQ ID NO: 438 - DNA, 21 bp, Artificial Sequence
  HIF-1 target sequence
catcagttgccacttccacat

SEQ ID NO: 439 - DNA, 21 bp, Artificial Sequence
  HIF-1 target sequence
cttggatggttttgttatggt

SEQ ID NO: 440 - DNA, 21 bp, Artificial Sequence
  HIF-1 target sequence
atgggattaactcagtttgaa

SEQ ID NO: 441 - DNA, 21 bp, Artificial Sequence
  HIF-1 target sequence
gtctgcaacatggaaggtatt

SEQ ID NO: 442 - DNA, 21 bp, Artificial Sequence
  HIF-1 target sequence
cattcctcacccatcaaatat

SEQ ID NO: 443 - DNA, 21 bp, Artificial Sequence
  HIF-1 target sequence
aggccgctcaatttatgaata

SEQ ID NO: 444 - DNA, 21 bp, Artificial Sequence
  HIF-1 target sequence
tcatatataacaccaagaatt

SEQ ID NO: 445 - DNA, 21 bp, Artificial Sequence
  HIF-1 target sequence
tgtccttaaaccggttgaatc

SEQ ID NO: 446 - DNA, 21 bp, Artificial Sequence
  HIF-1 target sequence
agcctctttgacaaacttaag

SEQ ID NO: 447 - DNA, 21 bp, Artificial Sequence
  HIF-1 target sequence
atgaccagcaacttgaggaag

SEQ ID NO: 448 - DNA, 21 bp, Artificial Sequence
  HIF-1 target sequence
cattacccaccgctgaaacgc

SEQ ID NO: 449 - DNA, 21 bp, Artificial Sequence
  HIF-1 target sequence
agattcaggatcagacaccta

SEQ ID NO: 450 - DNA, 21 bp, Artificial Sequence
  HIF-1 target sequence
atagtgatatggtcaatgaat

SEQ ID NO: 451 - DNA, 21 bp, Artificial Sequence
  HIF-1 target sequence
acacagatttagacttggaga

SEQ ID NO: 452 - DNA, 21 bp, Artificial Sequence
  HIF-1 target sequence
cacagttacagtattccagca

SEQ ID NO: 453 - DNA, 21 bp, Artificial Sequence
  HIF-1 target sequence
attgattgcatctccatctcc

SEQ ID NO: 454 - DNA, 21 bp, Artificial Sequence
  HIF-1 target sequence
atactagctttgcagaatgct

SEQ ID NO: 455 - DNA, 21 bp, Artificial Sequence
  HIF-1 target sequence
attattacagcagccagacga

SEQ ID NO: 456 - DNA, 21 bp, Artificial Sequence
  HIF-1 target sequence
acaattattttaataccctct

SEQ ID NO: 457 - DNA, 21 bp, Artificial Sequence
  HIF-1 target sequence
accagttatgattgtgaagtt

SEQ ID NO: 458 - DNA, 21 bp, Artificial Sequence
  HIF-1 target sequence
aactaactggacacagtgtgt

SEQ ID NO: 459 - DNA, 21 bp, Artificial Sequence
  Flt-1 target sequence
aagcaggccagacactgcatc

SEQ ID NO: 460 - DNA, 21 bp, Artificial Sequence
  Flt-1 target sequence
aatgcaggggggaagcagccc

SEQ ID NO: 461 - DNA, 21 bp, Artificial Sequence
  Flt-1 target sequence
aagcagcccataaatggtctt

SEQ ID NO: 462 - DNA, 21 bp, Artificial Sequence
  Flt-1 target sequence
aaatggtctttgcctgaaatg

SEQ ID NO: 463 - DNA, 21 bp, Artificial Sequence
  Flt-1 target sequence
aatggtctttgcctgaaatgg

SEQ ID NO: 464 - DNA, 21 bp, Artificial Sequence
  Flt-1 target sequence
aaatggtgagtaaggaaagcg

SEQ ID NO: 465 - DNA, 21 bp, Artificial Sequence
  Flt-1 target sequence
aatggtgagtaaggaaagcga

SEQ ID NO: 466 - DNA, 21 bp, Artificial Sequence
  Flt-1 target sequence
aaggaaagcgaaaggctgagc

SEQ ID NO: 467 - DNA, 21 bp, Artificial Sequence
  Flt-1 target sequence
aaagcgaaaggctgagcataa

SEQ ID NO: 468 - DNA, 21 bp, Artificial Sequence
  Flt-1 target sequence
aagcgaaaggctgagcataac

SEQ ID NO: 469 - DNA, 21 bp, Artificial Sequence
  Flt-1 target sequence
aaaggctgagcataactaaat

SEQ ID NO: 470 - DNA, 21 bp, Artificial Sequence
  Flt-1 target sequence
aaggctgagcataactaaatc

SEQ ID NO: 471 - DNA, 21 bp, Artificial Sequence
  Flt-1 target sequence
aactaaatctgcctgtggaag

SEQ ID NO: 472 - DNA, 21 bp, Artificial Sequence
  Flt-1 target sequence
aaatctgcctgtggaagaaat

SEQ ID NO: 473 - DNA, 21 bp, Artificial Sequence
  Flt-1 target sequence
aatctgcctgtggaagaaatg

SEQ ID NO: 474 - DNA, 21 bp, Artificial Sequence
  Flt-1 target sequence
aagaaatggcaaacaattctg

SEQ ID NO: 475 - DNA, 21 bp, Artificial Sequence
  Flt-1 target sequence
aaatggcaaacaattctgcag

SEQ ID NO: 476 - DNA, 21 bp, Artificial Sequence
  Flt-1 target sequence
aatggcaaacaattctgcagt

SEQ ID NO: 477 - DNA, 21 bp, Artificial Sequence
  Flt-1 target sequence
aaacaattctgcagtacttta

SEQ ID NO: 478 - DNA, 21 bp, Artificial Sequence
  Flt-1 target sequence
aacaattctgcagtactttaa

SEQ ID NO: 479 - DNA, 21 bp, Artificial Sequence
  Flt-1 target sequence
aattctgcagtactttaacct

SEQ ID NO: 480 - DNA, 21 bp, Artificial Sequence
  Flt-1 target sequence
aaccttgaacacagctcaagc

SEQ ID NO: 481 - DNA, 21 bp, Artificial Sequence
  Flt-1 target sequence
aacacagctcaagcaaaccac

SEQ ID NO: 482 - DNA, 21 bp, Artificial Sequence
  Flt-1 target sequence
aagcaaaccacactggcttct

SEQ ID NO: 483 - DNA, 21 bp, Artificial Sequence
  Flt-1 target sequence
aaaccacactggcttctacag

SEQ ID NO: 484 - DNA, 21 bp, Artificial Sequence
  Flt-1 target sequence
aaccacactggcttctacagc

SEQ ID NO: 485 - DNA, 21 bp, Artificial Sequence
  Flt-1 target sequence
aaatatctagctgtacctact

SEQ ID NO: 486 - DNA, 21 bp, Artificial Sequence
  Flt-1 target sequence
aatatctagctgtacctactt

SEQ ID NO: 487 - DNA, 21 bp, Artificial Sequence
  Flt-1 target sequence
aaagaagaaggaaacagaatc

SEQ ID NO: 488 - DNA, 21 bp, Artificial Sequence
  Flt-1 target sequence
aagaagaaggaaacagaatct

SEQ ID NO: 489 - DNA, 21 bp, Artificial Sequence
  Flt-1 target sequence
aagaaggaaacagaatctgca

SEQ ID NO: 490 - DNA, 21 bp, Artificial Sequence
  Flt-1 target sequence
aaggaaacagaatctgcaatc

SEQ ID NO: 491 - DNA, 21 bp, Artificial Sequence
  Flt-1 target sequence
aaacagaatctgcaatctata

SEQ ID NO: 492 - DNA, 21 bp, Artificial Sequence
  Flt-1 target sequence
aacagaatctgcaatctatat

SEQ ID NO: 493 - DNA, 21 bp, Artificial Sequence
  Flt-1 target sequence
aatctgcaatctatatattta

SEQ ID NO: 494 - DNA, 21 bp, Artificial Sequence
  Flt-1 target sequence
aatctatatatttattagtga

SEQ ID NO: 495 - DNA, 21 bp, Artificial Sequence
  Flt-1 target sequence
aaatccccgaaattatacaca

SEQ ID NO: 496 - DNA, 21 bp, Artificial Sequence
  Flt-1 target sequence
aatccccgaaattatacacat

SEQ ID NO: 497 - DNA, 21 bp, Artificial Sequence
  Flt-1 target sequence
aaattatacacatgactgaag

SEQ ID NO: 498 - DNA, 21 bp, Artificial Sequence
  Flt-1 target sequence
aattatacacatgactgaagg

SEQ ID NO: 499 - DNA, 21 bp, Artificial Sequence
  Flt-1 target sequence
aaggaagggagctcgtcattc

SEQ ID NO: 500 - DNA, 21 bp, Artificial Sequence
  Flt-1 target sequence
aagggagctcgtcattccctg

SEQ ID NO: 501 - DNA, 21 bp, Artificial Sequence
  Flt-1 target sequence
aacatcactgttactttaaaa

SEQ ID NO: 502 - DNA, 21 bp, Artificial Sequence
  Flt-1 target sequence
aaaaaagtttccacttgacac

SEQ ID NO: 503 - DNA, 21 bp, Artificial Sequence
  Flt-1 target sequence
aaaaagtttccacttgacact

SEQ ID NO: 504 - DNA, 21 bp, Artificial Sequence
  Flt-1 target sequence
aaaagtttccacttgacactt

SEQ ID NO: 505 - DNA, 21 bp, Artificial Sequence
  Flt-1 target sequence
aaagtttccacttgacacttt

SEQ ID NO: 506 - DNA, 21 bp, Artificial Sequence
  Flt-1 target sequence
aagtttccacttgacactttg

SEQ ID NO: 507 - DNA, 21 bp, Artificial Sequence
  Flt-1 target sequence
aaaacgcataatctgggacag

SEQ ID NO: 508 - DNA, 21 bp, Artificial Sequence
  Flt-1 target sequence
aaacgcataatctgggacagt

SEQ ID NO: 509 - DNA, 21 bp, Artificial Sequence
  Flt-1 target sequence
aacgcataatctgggacagta

SEQ ID NO: 510 - DNA, 21 bp, Artificial Sequence
  Flt-1 target sequence
aatctgggacagtagaaaggg

SEQ ID NO: 511 - DNA, 21 bp, Artificial Sequence
  Flt-1 target sequence
aaagggcttcatcatatcaaa

SEQ ID NO: 512 - DNA, 21 bp, Artificial Sequence
  Flt-1 target sequence
aagggcttcatcatatcaaat

SEQ ID NO: 513 - DNA, 21 bp, Artificial Sequence
  Flt-1 target sequence
aaatgcaacgtacaaagaaat

SEQ ID NO: 514 - DNA, 21 bp, Artificial Sequence
  Flt-1 target sequence
aatgcaacgtacaaagaaata

SEQ ID NO: 515 - DNA, 21 bp, Artificial Sequence
  Flt-1 target sequence
aacgtacaaagaaatagggct

SEQ ID NO: 516 - DNA, 21 bp, Artificial Sequence
  Flt-1 target sequence
aaagaaatagggcttctgacc

SEQ ID NO: 517 - DNA, 21 bp, Artificial Sequence
  Flt-1 target sequence
aagaaatagggcttctgacct

SEQ ID NO: 518 - DNA, 21 bp, Artificial Sequence
  Flt-1 target sequence
aaatagggcttctgacctgtg

SEQ ID NO: 519 - DNA, 21 bp, Artificial Sequence
  Flt-1 target sequence
aatagggcttctgacctgtga

SEQ ID NO: 520 - DNA, 21 bp, Artificial Sequence
  Flt-1 target sequence
aagcaacagtcaatgggcatt

SEQ ID NO: 521 - DNA, 21 bp, Artificial Sequence
  Flt-1 target sequence
aacagtcaatgggcatttgta

SEQ ID NO: 522 - DNA, 21 bp, Artificial Sequence
  Flt-1 target sequence
aatgggcatttgtataagaca

SEQ ID NO: 523 - DNA, 21 bp, Artificial Sequence
  Flt-1 target sequence
aagacaaactatctcacacat

SEQ ID NO: 524 - DNA, 21 bp, Artificial Sequence
  Flt-1 target sequence
aaactatctcacacatcgaca

SEQ ID NO: 525 - DNA, 21 bp, Artificial Sequence
  Flt-1 target sequence
aactatctcacacatcgacaa

SEQ ID NO: 526 - DNA, 21 bp, Artificial Sequence
  Flt-1 target sequence
aaaccaatacaatcatagatg

SEQ ID NO: 527 - DNA, 21 bp, Artificial Sequence
  Flt-1 target sequence
aaccaatacaatcatagatgt

SEQ ID NO: 528 - DNA, 21 bp, Artificial Sequence
  Flt-1 target sequence
aatacaatcatagatgtccaa

SEQ ID NO: 529 - DNA, 21 bp, Artificial Sequence
  Flt-1 target sequence
aatcatagatgtccaaataag

SEQ ID NO: 530 - DNA, 21 bp, Artificial Sequence
  Flt-1 target sequence
aaataagcacaccacgcccag

SEQ ID NO: 531 - DNA, 21 bp, Artificial Sequence
  Flt-1 target sequence
aataagcacaccacgcccagt

SEQ ID NO: 532 - DNA, 21 bp, Artificial Sequence
  Flt-1 target sequence
aagcacaccacgcccagtcaa

SEQ ID NO: 533 - DNA, 21 bp, Artificial Sequence
  Flt-1 target sequence
aaattacttagaggccatact

SEQ ID NO: 534 - DNA, 21 bp, Artificial Sequence
  Flt-1 target sequence
aattacttagaggccatactc

SEQ ID NO: 535 - DNA, 21 bp, Artificial Sequence
  Flt-1 target sequence
aattgtactgctaccactccc

SEQ ID NO: 536 - DNA, 21 bp, Artificial Sequence
  Flt-1 target sequence
aacacgagagttcaaatgacc

SEQ ID NO: 537 - DNA, 21 bp, Artificial Sequence
  Flt-1 target sequence
aaatgacctggagttaccctg

SEQ ID NO: 538 - DNA, 21 bp, Artificial Sequence
  Flt-1 target sequence
aatgacctggagttaccctga

SEQ ID NO: 539 - DNA, 21 bp, Artificial Sequence
  Flt-1 target sequence
aaaaaaataagagagcttccg

SEQ ID NO: 540 - DNA, 21 bp, Artificial Sequence
  Flt-1 target sequence
aaaaaataagagagcttccgt

SEQ ID NO: 541 - DNA, 21 bp, Artificial Sequence
  Flt-1 target sequence
aaaaataagagagcttccgta

SEQ ID NO: 542 - DNA, 21 bp, Artificial Sequence
  Flt-1 target sequence
aaaataagagagcttccgtaa

SEQ ID NO: 543 - DNA, 21 bp, Artificial Sequence
  Flt-1 target sequence
aaataagagagcttccgtaag

SEQ ID NO: 544 - DNA, 21 bp, Artificial Sequence
  Flt-1 target sequence
aataagagagcttccgtaagg

SEQ ID NO: 545 - DNA, 21 bp, Artificial Sequence
  Flt-1 target sequence
aagagagcttccgtaaggcga

SEQ ID NO: 546 - DNA, 21 bp, Artificial Sequence
  Flt-1 target sequence
aaggcgacgaattgaccaaag

SEQ ID NO: 547 - DNA, 21 bp, Artificial Sequence
  Flt-1 target sequence
aattgaccaaagcaattccca

SEQ ID NO: 548 - DNA, 21 bp, Artificial Sequence
  Flt-1 target sequence
aaagcaattcccatgccaaca

SEQ ID NO: 549 - DNA, 21 bp, Artificial Sequence
  Flt-1 target sequence
aagcaattcccatgccaacat

SEQ ID NO: 550 - DNA, 21 bp, Artificial Sequence
  Flt-1 target sequence
aattcccatgccaacatattc

SEQ ID NO: 551 - DNA, 21 bp, Artificial Sequence
  Flt-1 target sequence
aacatattctacagtgttctt

SEQ ID NO: 552 - DNA, 21 bp, Artificial Sequence
  Flt-1 target sequence
aaaatgcagaacaaagacaaa

SEQ ID NO: 553 - DNA, 21 bp, Artificial Sequence
  Flt-1 target sequence
aatgcagaacaaagacaaagg

SEQ ID NO: 554 - DNA, 21 bp, Artificial Sequence
  Flt-1 target sequence
aacaaagacaaaggactttat

SEQ ID NO: 555 - DNA, 21 bp, Artificial Sequence
  Flt-1 target sequence
aaagacaaaggactttatact

SEQ ID NO: 556 - DNA, 21 bp, Artificial Sequence
  Flt-1 target sequence
aagacaaaggactttatactt

SEQ ID NO: 557 - DNA, 21 bp, Artificial Sequence
  Flt-1 target sequence
aaaggactttatacttgtcgt

SEQ ID NO: 558 - DNA, 21 bp, Artificial Sequence
  Flt-1 target sequence
aaggactttatacttgtcgtg

SEQ ID NO: 559 - DNA, 21 bp, Artificial Sequence
  Flt-1 target sequence
aaggagtggaccatcattcaa

SEQ ID NO: 560 - DNA, 21 bp, Artificial Sequence
  Flt-1 target sequence
aaatctgttaacacctcagtg

SEQ ID NO: 561 - DNA, 21 bp, Artificial Sequence
  Flt-1 target sequence
aatctgttaacacctcagtgc

SEQ ID NO: 562 - DNA, 21 bp, Artificial Sequence
  Flt-1 target sequence
aacacctcagtgcatatatat

SEQ ID NO: 563 - DNA, 21 bp, Artificial Sequence
  Flt-1 target sequence
aaagcattcatcactgtgaaa

SEQ ID NO: 564 - DNA, 21 bp, Artificial Sequence
  Flt-1 target sequence
aagcattcatcactgtgaaac

SEQ ID NO: 565 - DNA, 21 bp, Artificial Sequence
  Flt-1 target sequence
aaacatcgaaaacagcaggtg

SEQ ID NO: 566 - DNA, 21 bp, Artificial Sequence
  Flt-1 target sequence
aacatcgaaaacagcaggtgc

SEQ ID NO: 567 - DNA, 21 bp, Artificial Sequence
  Flt-1 target sequence
aaaacagcaggtgcttgaaac

SEQ ID NO: 568 - DNA, 21 bp, Artificial Sequence
  Flt-1 target sequence
aaacagcaggtgcttgaaacc

SEQ ID NO: 569 - DNA, 21 bp, Artificial Sequence
  Flt-1 target sequence
aacagcaggtgcttgaaaccg

SEQ ID NO: 570 - DNA, 21 bp, Artificial Sequence
  Flt-1 target sequence
aaaccgtagctggcaagcggt

SEQ ID NO: 571 - DNA, 21 bp, Artificial Sequence
  Flt-1 target sequence
aaccgtagctggcaagcggtc

SEQ ID NO: 572 - DNA, 21 bp, Artificial Sequence
  Flt-1 target sequence
aaccgtagctggcaagcggtc

SEQ ID NO: 573 - DNA, 21 bp, Artificial Sequence
  Flt-1 target sequence
aaagtgaaggcatttccctcg

SEQ ID NO: 574 - DNA, 21 bp, Artificial Sequence
  Flt-1 target sequence
aagtgaaggcatttccctcgc

SEQ ID NO: 575 - DNA, 21 bp, Artificial Sequence
  Flt-1 target sequence
aaggcatttccctcgccggaa

SEQ ID NO: 576 - DNA, 21 bp, Artificial Sequence
  Flt-1 target sequence
aagttgtatggttaaaagatg

SEQ ID NO: 577 - DNA, 21 bp, Artificial Sequence
  Flt-1 target sequence
aaaagatgggttacctgcgac

SEQ ID NO: 578 - DNA, 21 bp, Artificial Sequence
  Flt-1 target sequence
aaagatgggttacctgcgact

SEQ ID NO: 579 - DNA, 21 bp, Artificial Sequence
  Flt-1 target sequence
aagatgggttacctgcgactg

SEQ ID NO: 580 - DNA, 21 bp, Artificial Sequence
  Flt-1 target sequence
aaatctgctcgctatttgact

SEQ ID NO: 581 - DNA, 21 bp, Artificial Sequence
  Flt-1 target sequence
aatctgctcgctatttgactc

SEQ ID NO: 582 - DNA, 21 bp, Artificial Sequence
  Flt-1 target sequence
aattatcaaggacgtaactga

SEQ ID NO: 583 - DNA, 21 bp, Artificial Sequence
  Flt-1 target sequence
aaggacgtaactgaagaggat

SEQ ID NO: 584 - DNA, 21 bp, Artificial Sequence
  Flt-1 target sequence
aactgaagaggatgcagggaa

SEQ ID NO: 585 - DNA, 21 bp, Artificial Sequence
  Flt-1 target sequence
aagaggatgcagggaattata

SEQ ID NO: 586 - DNA, 21 bp, Artificial Sequence
  Flt-1 target sequence
aattatacaatcttgctgagc

SEQ ID NO: 587 - DNA, 21 bp, Artificial Sequence
  Flt-1 target sequence
aatcttgctgagcataaaaca

SEQ ID NO: 588 - DNA, 21 bp, Artificial Sequence
  Flt-1 target sequence
aaaacagtcaaatgtgtttaa

SEQ ID NO: 589 - DNA, 21 bp, Artificial Sequence
  Flt-1 target sequence
aaacagtcaaatgtgtttaaa

SEQ ID NO: 590 - DNA, 21 bp, Artificial Sequence
  Flt-1 target sequence
aacagtcaaatgtgtttaaaa

SEQ ID NO: 591 - DNA, 21 bp, Artificial Sequence
  Flt-1 target sequence
aaatgtgtttaaaaacctcac

SEQ ID NO: 592 - DNA, 21 bp, Artificial Sequence
  Flt-1 target sequence
aatgtgtttaaaaacctcact

SEQ ID NO: 593 - DNA, 21 bp, Artificial Sequence
  Flt-1 target sequence
aaaaacctcactgccactcta

SEQ ID NO: 594 - DNA, 21 bp, Artificial Sequence
  Flt-1 target sequence
aaaacctcactgccactctaa

SEQ ID NO: 595 - DNA, 21 bp, Artificial Sequence
  Flt-1 target sequence
aaacctcactgccactctaat

SEQ ID NO: 596 - DNA, 21 bp, Artificial Sequence
  Flt-1 target sequence
aacctcactgccactctaatt

SEQ ID NO: 597 - DNA, 21 bp, Artificial Sequence
  Flt-1 target sequence
aattgtcaatgtgaaacccca

SEQ ID NO: 598 - DNA, 21 bp, Artificial Sequence
  Flt-1 target sequence
aatgtgaaaccccagatttac

SEQ ID NO: 599 - DNA, 21 bp, Artificial Sequence
  Flt-1 target sequence
aaaccccagatttacgaaaag

SEQ ID NO: 600 - DNA, 21 bp, Artificial Sequence
  Flt-1 target sequence
aaccccagatttacgaaaagg

SEQ ID NO: 601 - DNA, 21 bp, Artificial Sequence
  Flt-1 target sequence
aaaaggccgtgtcatcgtttc

SEQ ID NO: 602 - DNA, 21 bp, Artificial Sequence
  Flt-1 target sequence
aaaggccgtgtcatcgtttcc

SEQ ID NO: 603 - DNA, 21 bp, Artificial Sequence
  Flt-1 target sequence
aaggccgtgtcatcgtttcca

SEQ ID NO: 604 - DNA, 21 bp, Artificial Sequence
  Flt-1 target sequence
aaatcctgacttgtaccgcat

SEQ ID NO: 605 - DNA, 21 bp, Artificial Sequence
  Flt-1 target sequence
aatcctgacttgtaccgcata

SEQ ID NO: 606 - DNA, 21 bp, Artificial Sequence
  Flt-1 target sequence
aacctacaatcaagtggttct

SEQ ID NO: 607 - DNA, 21 bp, Artificial Sequence
  Flt-1 target sequence
aatcaagtggttctggcaccc

SEQ ID NO: 608 - DNA, 21 bp, Artificial Sequence
  Flt-1 target sequence
aagtggttctggcacccctgt

SEQ ID NO: 609 - DNA, 21 bp, Artificial Sequence
  Flt-1 target sequence
aaccataatcattccgaagca

SEQ ID NO: 610 - DNA, 21 bp, Artificial Sequence
  Flt-1 target sequence
aatcattccgaagcaaggtgt

SEQ ID NO: 611 - DNA, 21 bp, Artificial Sequence
  Flt-1 target sequence
aagcaaggtgtgacttttgtt

SEQ ID NO: 612 - DNA, 21 bp, Artificial Sequence
  Flt-1 target sequence
aaggtgtgacttttgttccaa

SEQ ID NO: 613 - DNA, 21 bp, Artificial Sequence
  Flt-1 target sequence
aataatgaagagtcctttatc

SEQ ID NO: 614 - DNA, 21 bp, Artificial Sequence
  Flt-1 target sequence
aatgaagagtcctttatcctg

SEQ ID NO: 615 - DNA, 21 bp, Artificial Sequence
  Flt-1 target sequence
aagagtcctttatcctggatg

SEQ ID NO: 616 - DNA, 21 bp, Artificial Sequence
  Flt-1 target sequence
aacatgggaaacagaattgag

SEQ ID NO: 617 - DNA, 21 bp, Artificial Sequence
  Flt-1 target sequence
aaacagaattgagagcatcac

SEQ ID NO: 618 - DNA, 21 bp, Artificial Sequence
  Flt-1 target sequence
aacagaattgagagcatcact

SEQ ID NO: 619 - DNA, 21 bp, Artificial Sequence
  Flt-1 target sequence
aattgagagcatcactcagcg

SEQ ID NO: 620 - DNA, 21 bp, Artificial Sequence
  Flt-1 target sequence
aataatagaaggaaagaataa

SEQ ID NO: 621 - DNA, 21 bp, Artificial Sequence
  Flt-1 target sequence
aatagaaggaaagaataagat

SEQ ID NO: 622 - DNA, 21 bp, Artificial Sequence
  Flt-1 target sequence
aaggaaagaataagatggcta

SEQ ID NO: 623 - DNA, 21 bp, Artificial Sequence
  Flt-1 target sequence
aaagaataagatggctagcac

SEQ ID NO: 624 - DNA, 21 bp, Artificial Sequence
  Flt-1 target sequence
aagaataagatggctagcacc

SEQ ID NO: 625 - DNA, 21 bp, Artificial Sequence
  Flt-1 target sequence
aataagatggctagcaccttg

SEQ ID NO: 626 - DNA, 21 bp, Artificial Sequence
  Flt-1 target sequence
aagatggctagcaccttggtt

SEQ ID NO: 627 - DNA, 21 bp, Artificial Sequence
  Flt-1 target sequence
aatttctggaatctacatttg

SEQ ID NO: 628 - DNA, 21 bp, Artificial Sequence
  Flt-1 target sequence
aatctacatttgcatagcttc

SEQ ID NO: 629 - DNA, 21 bp, Artificial Sequence
  Flt-1 target sequence
aataaagttgggactgtggga

SEQ ID NO: 630 - DNA, 21 bp, Artificial Sequence
  Flt-1 target sequence
aaagttgggactgtgggaaga

SEQ ID NO: 631 - DNA, 21 bp, Artificial Sequence
  Flt-1 target sequence
aagttgggactgtgggaagaa

SEQ ID NO: 632 - DNA, 21 bp, Artificial Sequence
  Flt-1 target sequence
aagaaacataagcttttatat

SEQ ID NO: 633 - DNA, 21 bp, Artificial Sequence
  Flt-1 target sequence
aaacataagcttttatatcac

SEQ ID NO: 634 - DNA, 21 bp, Artificial Sequence
  Flt-1 target sequence
aacataagcttttatatcaca

SEQ ID NO: 635 - DNA, 21 bp, Artificial Sequence
  Flt-1 target sequence
aagcttttatatcacagatgt

SEQ ID NO: 636 - DNA, 21 bp, Artificial Sequence
  Flt-1 target sequence
aaatgggtttcatgttaactt

SEQ ID NO: 637 - DNA, 21 bp, Artificial Sequence
  Flt-1 target sequence
aatgggtttcatgttaacttg

SEQ ID NO: 638 - DNA, 21 bp, Artificial Sequence
  Flt-1 target sequence
aacttggaaaaaatgccgacg

SEQ ID NO: 639 - DNA, 21 bp, Artificial Sequence
  Flt-1 target sequence
aaaaaatgccgacggaaggag

SEQ ID NO: 640 - DNA, 21 bp, Artificial Sequence
  Flt-1 target sequence
aaaaatgccgacggaaggaga

SEQ ID NO: 641 - DNA, 21 bp, Artificial Sequence
  Flt-1 target sequence
aaaatgccgacggaaggagag

SEQ ID NO: 642 - DNA, 21 bp, Artificial Sequence
  Flt-1 target sequence
aaatgccgacggaaggagagg

SEQ ID NO: 643 - DNA, 21 bp, Artificial Sequence
  Flt-1 target sequence
aatgccgacggaaggagagga

SEQ ID NO: 644 - DNA, 21 bp, Artificial Sequence
  Flt-1 target sequence
aaggagaggacctgaaactgt

SEQ ID NO: 645 - DNA, 21 bp, Artificial Sequence
  Flt-1 target sequence
aaactgtcttgcacagttaac

SEQ ID NO: 646 - DNA, 21 bp, Artificial Sequence
  Flt-1 target sequence
aactgtcttgcacagttaaca

SEQ ID NO: 647 - DNA, 21 bp, Artificial Sequence
  Flt-1 target sequence
aacaagttcttatacagagac

SEQ ID NO: 648 - DNA, 21 bp, Artificial Sequence
  Flt-1 target sequence
aagttcttatacagagacgtt

SEQ ID NO: 649 - DNA, 21 bp, Artificial Sequence
  Flt-1 target sequence
aataacagaacaatgcactac

SEQ ID NO: 650 - DNA, 21 bp, Artificial Sequence
  Flt-1 target sequence
aacagaacaatgcactacagt

SEQ ID NO: 651 - DNA, 21 bp, Artificial Sequence
  Flt-1 target sequence
aacaatgcactacagtattag

SEQ ID NO: 652 - DNA, 21 bp, Artificial Sequence
  Flt-1 target sequence
aatgcactacagtattagcaa

SEQ ID NO: 653 - DNA, 21 bp, Artificial Sequence
  Flt-1 target sequence
aagcaaaaaatggccatcact

SEQ ID NO: 654 - DNA, 21 bp, Artificial Sequence
  Flt-1 target sequence
aaaaaatggccatcactaagg

SEQ ID NO: 655 - DNA, 21 bp, Artificial Sequence
  Flt-1 target sequence
aaaaatggccatcactaagga

SEQ ID NO: 656 - DNA, 21 bp, Artificial Sequence
  Flt-1 target sequence
aaaatggccatcactaaggag

SEQ ID NO: 657 - DNA, 21 bp, Artificial Sequence
  Flt-1 target sequence
aaatggccatcactaaggagc

SEQ ID NO: 658 - DNA, 21 bp, Artificial Sequence
  Flt-1 target sequence
aatggccatcactaaggagca

SEQ ID NO: 659 - DNA, 21 bp, Artificial Sequence
  Flt-1 target sequence
aaggagcactccatcactctt

SEQ ID NO: 660 - DNA, 21 bp, Artificial Sequence
  Flt-1 target sequence
aatcttaccatcatgaatgtt

SEQ ID NO: 661 - DNA, 21 bp, Artificial Sequence
  Flt-1 target sequence
aatgtttccctgcaagattca

SEQ ID NO: 662 - DNA, 21 bp, Artificial Sequence
  Flt-1 target sequence
aagattcaggcacctatgcct

SEQ ID NO: 663 - DNA, 21 bp, Artificial Sequence
  Flt-1 target sequence
aatgtatacacaggggaagaa

SEQ ID NO: 664 - DNA, 21 bp, Artificial Sequence
  Flt-1 target sequence
aagaaatcctccagaagaaag

SEQ ID NO: 665 - DNA, 21 bp, Artificial Sequence
  Flt-1 target sequence
aaatcctccagaagaaagaaa

SEQ ID NO: 666 - DNA, 21 bp, Artificial Sequence
  Flt-1 target sequence
aatcctccagaagaaagaaat

SEQ ID NO: 667 - DNA, 21 bp, Artificial Sequence
  Flt-1 target sequence
aagaaagaaattacaatcaga

SEQ ID NO: 668 - DNA, 21 bp, Artificial Sequence
  Flt-1 target sequence
aaagaaattacaatcagagat

SEQ ID NO: 669 - DNA, 21 bp, Artificial Sequence
  Flt-1 target sequence
aagaaattacaatcagagatc

SEQ ID NO: 670 - DNA, 21 bp, Artificial Sequence
  Flt-1 target sequence
aaattacaatcagagatcagg

SEQ ID NO: 671 - DNA, 21 bp, Artificial Sequence
  Flt-1 target sequence
aattacaatcagagatcagga

SEQ ID NO: 672 - DNA, 21 bp, Artificial Sequence
  Flt-1 target sequence
aatcagagatcaggaagcacc

SEQ ID NO: 673 - DNA, 21 bp, Artificial Sequence
  Flt-1 target sequence
aagcaccatacctcctgcgaa

SEQ ID NO: 674 - DNA, 21 bp, Artificial Sequence
  Flt-1 target sequence
aaacctcagtgatcacacagt

SEQ ID NO: 675 - DNA, 20 bp, Artificial Sequence
  Flt-1 target sequence
aacctcagtgatcacacagt

SEQ ID NO: 676 - DNA, 21 bp, Artificial Sequence
  Flt-1 target sequence
aatggtgtccccgagcctcag

SEQ ID NO: 677 - DNA, 21 bp, Artificial Sequence
  Flt-1 target sequence
aaaaacaaccacaaaatacaa

SEQ ID NO: 678 - DNA, 21 bp, Artificial Sequence
  Flt-1 target sequence
aaaacaaccacaaaatacaac

SEQ ID NO: 679 - DNA, 21 bp, Artificial Sequence
  Flt-1 target sequence
aaacaaccacaaaatacaaca

SEQ ID NO: 680 - DNA, 21 bp, Artificial Sequence
  Flt-1 target sequence
aacaaccacaaaatacaacaa

SEQ ID NO: 681 - DNA, 21 bp, Artificial Sequence
  Flt-1 target sequence
aaccacaaaatacaacaagag

SEQ ID NO: 682 - DNA, 21 bp, Artificial Sequence
  Flt-1 target sequence
aaaatacaacaagagcctgga

SEQ ID NO: 683 - DNA, 21 bp, Artificial Sequence
  Flt-1 target sequence
aaatacaacaagagcctggaa

SEQ ID NO: 684 - DNA, 21 bp, Artificial Sequence
  Flt-1 target sequence
aatacaacaagagcctggaat

SEQ ID NO: 685 - DNA, 21 bp, Artificial Sequence
  Flt-1 target sequence
aacaagagcctggaattattt

SEQ ID NO: 686 - DNA, 21 bp, Artificial Sequence
  Flt-1 target sequence
aagagcctggaattattttag

SEQ ID NO: 687 - DNA, 21 bp, Artificial Sequence
  Flt-1 target sequence
aattattttaggaccaggaag

SEQ ID NO: 688 - DNA, 21 bp, Artificial Sequence
  Flt-1 target sequence
aagcagcacgctgtttattga

SEQ ID NO: 689 - DNA, 21 bp, Artificial Sequence
  Flt-1 target sequence
aaagagtcacagaagaggatg

SEQ ID NO: 690 - DNA, 21 bp, Artificial Sequence
  Flt-1 target sequence
aagagtcacagaagaggatga

SEQ ID NO: 691 - DNA, 21 bp, Artificial Sequence
  Flt-1 target sequence
aagaggatgaaggtgtctatc

SEQ ID NO: 692 - DNA, 21 bp, Artificial Sequence
  Flt-1 target sequence
aaggtgtctatcactgcaaag

SEQ ID NO: 693 - DNA, 21 bp, Artificial Sequence
  Flt-1 target sequence
aaagccaccaaccagaagggc

SEQ ID NO: 694 - DNA, 21 bp, Artificial Sequence
  Flt-1 target sequence
aagccaccaaccagaagggct

SEQ ID NO: 695 - DNA, 21 bp, Artificial Sequence
  Flt-1 target sequence
aaccagaagggctctgtggaa

SEQ ID NO: 696 - DNA, 21 bp, Artificial Sequence
  Flt-1 target sequence
aagggctctgtggaaagttca

SEQ ID NO: 697 - DNA, 21 bp, Artificial Sequence
  Flt-1 target sequence
aaagttcagcatacctcactg

SEQ ID NO: 698 - DNA, 21 bp, Artificial Sequence
  Flt-1 target sequence
aagttcagcatacctcactgt

SEQ ID NO: 699 - DNA, 21 bp, Artificial Sequence
  Flt-1 target sequence
aaggaacctcggacaagtcta

SEQ ID NO: 700 - DNA, 21 bp, Artificial Sequence
  Flt-1 target sequence
aacctcggacaagtctaatct

SEQ ID NO: 701 - DNA, 21 bp, Artificial Sequence
  Flt-1 target sequence
aagtctaatctggagctgatc

SEQ ID NO: 702 - DNA, 21 bp, Artificial Sequence
  Flt-1 target sequence
aatctggagctgatcactcta

SEQ ID NO: 703 - DNA, 21 bp, Artificial Sequence
  Flt-1 target sequence
aacatgcacctgtgtggctgc

SEQ ID NO: 704 - DNA, 21 bp, Artificial Sequence
  Flt-1 target sequence
aaccctctttatccgaaaaat

SEQ ID NO: 705 - DNA, 21 bp, Artificial Sequence
  Flt-1 target sequence
aaaaatgaaaaggtcttcttc

SEQ ID NO: 706 - DNA, 21 bp, Artificial Sequence
  Flt-1 target sequence
aaaatgaaaaggtcttcttct

SEQ ID NO: 707 - DNA, 21 bp, Artificial Sequence
  Flt-1 target sequence
aaatgaaaaggtcttcttctg

SEQ ID NO: 708 - DNA, 21 bp, Artificial Sequence
  Flt-1 target sequence
aatgaaaaggtcttcttctga

SEQ ID NO: 709 - DNA, 21 bp, Artificial Sequence
  Flt-1 target sequence
aaaaggtcttcttctgaaata

SEQ ID NO: 710 - DNA, 21 bp, Artificial Sequence
  Flt-1 target sequence
aaaggtcttcttctgaaataa

SEQ ID NO: 711 - DNA, 21 bp, Artificial Sequence
  Flt-1 target sequence
aaggtcttcttctgaaataaa

SEQ ID NO: 712 - DNA, 21 bp, Artificial Sequence
  Flt-1 target sequence
aaataaagactgactacctat

SEQ ID NO: 713 - DNA, 21 bp, Artificial Sequence
  Flt-1 target sequence
aataaagactgactacctatc

SEQ ID NO: 714 - DNA, 21 bp, Artificial Sequence
  Flt-1 target sequence
aaagactgactacctatcaat

SEQ ID NO: 715 - DNA, 21 bp, Artificial Sequence
  Flt-1 target sequence
aagactgactacctatcaatt

SEQ ID NO: 716 - DNA, 21 bp, Artificial Sequence
  Flt-1 target sequence
aattataatggacccagatga

SEQ ID NO: 717 - DNA, 21 bp, Artificial Sequence
  Flt-1 target sequence
aatggacccagatgaagttcc

SEQ ID NO: 718 - DNA, 21 bp, Artificial Sequence
  Flt-1 target sequence
aagttcctttggatgagcagt

SEQ ID NO: 719 - DNA, 21 bp, Artificial Sequence
  Flt-1 target sequence
aagtgggagtttgcccgggag

SEQ ID NO: 720 - DNA, 21 bp, Artificial Sequence
  Flt-1 target sequence
aaactgggcaaatcacttgga

SEQ ID NO: 721 - DNA, 21 bp, Artificial Sequence
  Flt-1 target sequence
aactgggcaaatcacttggaa

SEQ ID NO: 722 - DNA, 21 bp, Artificial Sequence
  Flt-1 target sequence
aaatcacttggaagaggggct

SEQ ID NO: 723 - DNA, 21 bp, Artificial Sequence
  Flt-1 target sequence
aatcacttggaagaggggctt

SEQ ID NO: 724 - DNA, 21 bp, Artificial Sequence
  Flt-1 target sequence
aagaggggcttttggaaaagt

SEQ ID NO: 725 - DNA, 21 bp, Artificial Sequence
  Flt-1 target sequence
aaaagtggttcaagcatcagc

SEQ ID NO: 726 - DNA, 21 bp, Artificial Sequence
  Flt-1 target sequence
aaagtggttcaagcatcagca

SEQ ID NO: 727 - DNA, 21 bp, Artificial Sequence
  Flt-1 target sequence
aagtggttcaagcatcagcat

SEQ ID NO: 728 - DNA, 21 bp, Artificial Sequence
  Flt-1 target sequence
aagcatcagcatttggcatta

SEQ ID NO: 729 - DNA, 21 bp, Artificial Sequence
  Flt-1 target sequence
aagaaatcacctacgtgccgg

SEQ ID NO: 730 - DNA, 21 bp, Artificial Sequence
  Flt-1 target sequence
aaatcacctacgtgccggact

SEQ ID NO: 731 - DNA, 21 bp, Artificial Sequence
  Flt-1 target sequence
aatcacctacgtgccggactg

SEQ ID NO: 732 - DNA, 21 bp, Artificial Sequence
  Flt-1 target sequence
aaaatgctgaaagagggggcc

SEQ ID NO: 733 - DNA, 21 bp, Artificial Sequence
  Flt-1 target sequence
aaatgctgaaagagggggcca

SEQ ID NO: 734 - DNA, 21 bp, Artificial Sequence
  Flt-1 target sequence
aatgctgaaagagggggccac

SEQ ID NO: 735 - DNA, 21 bp, Artificial Sequence
  Flt-1 target sequence
aaagagggggccacggccagc

SEQ ID NO: 736 - DNA, 21 bp, Artificial Sequence
  Flt-1 target sequence
aagagggggccacggccagcg

SEQ ID NO: 737 - DNA, 21 bp, Artificial Sequence
  Flt-1 target sequence
aaagctctgatgactgagcta

SEQ ID NO: 738 - DNA, 21 bp, Artificial Sequence
  Flt-1 target sequence
aagctctgatgactgagctaa

SEQ ID NO: 739 - DNA, 21 bp, Artificial Sequence
  Flt-1 target sequence
aaaaatcttgacccacattgg

SEQ ID NO: 740 - DNA, 21 bp, Artificial Sequence
  Flt-1 target sequence
aaaatcttgacccacattggc

SEQ ID NO: 741 - DNA, 21 bp, Artificial Sequence
  Flt-1 target sequence
aaatcttgacccacattggcc

SEQ ID NO: 742 - DNA, 21 bp, Artificial Sequence
  Flt-1 target sequence
aatcttgacccacattggcca

SEQ ID NO: 743 - DNA, 21 bp, Artificial Sequence
  Flt-1 target sequence
aacgtggttaacctgctggga

SEQ ID NO: 744 - DNA, 21 bp, Artificial Sequence
  Flt-1 target sequence
aacctgctgggagcctgcacc

SEQ ID NO: 745 - DNA, 21 bp, Artificial Sequence
  Flt-1 target sequence
aagcaaggagggcctctgatg

SEQ ID NO: 746 - DNA, 21 bp, Artificial Sequence
  Flt-1 target sequence
aaggagggcctctgatggtga

SEQ ID NO: 747 - DNA, 21 bp, Artificial Sequence
  Flt-1 target sequence
aatactgcaaatatggaaatc

SEQ ID NO: 748 - DNA, 21 bp, Artificial Sequence
  Flt-1 target sequence
aaatatggaaatctctccaac

SEQ ID NO: 749 - DNA, 21 bp, Artificial Sequence
  Flt-1 target sequence
aatatggaaatctctccaact

SEQ ID NO: 750 - DNA, 21 bp, Artificial Sequence
  Flt-1 target sequence
aaatctctccaactacctcaa

SEQ ID NO: 751 - DNA, 21 bp, Artificial Sequence
  Flt-1 target sequence
aatctctccaactacctcaag

SEQ ID NO: 752 - DNA, 21 bp, Artificial Sequence
  Flt-1 target sequence
aactacctcaagagcaaacgt

SEQ ID NO: 753 - DNA, 21 bp, Artificial Sequence
  Flt-1 target sequence
aagagcaaacgtgacttattt

SEQ ID NO: 754 - DNA, 21 bp, Artificial Sequence
  Flt-1 target sequence
aaacgtgacttattttttctc

SEQ ID NO: 755 - DNA, 21 bp, Artificial Sequence
  Flt-1 target sequence
aacgtgacttattttttctca

SEQ ID NO: 756 - DNA, 21 bp, Artificial Sequence
  Flt-1 target sequence
aacaaggatgcagcactacac

SEQ ID NO: 757 - DNA, 21 bp, Artificial Sequence
  Flt-1 target sequence
aaggatgcagcactacacatg

SEQ ID NO: 758 - DNA, 21 bp, Artificial Sequence
  Flt-1 target sequence
aagaaagaaaaaatggagcca

SEQ ID NO: 759 - DNA, 21 bp, Artificial Sequence
  Flt-1 target sequence
aaagaaaaaatggagccaggc

SEQ ID NO: 760 - DNA, 21 bp, Artificial Sequence
  Flt-1 target sequence
aagaaaaaatggagccaggcc

SEQ ID NO: 761 - DNA, 21 bp, Artificial Sequence
  Flt-1 target sequence
aaaaaatggagccaggcctgg

SEQ ID NO: 762 - DNA, 21 bp, Artificial Sequence
  Flt-1 target sequence
aaaaatggagccaggcctgga

SEQ ID NO: 763 - DNA, 21 bp, Artificial Sequence
  Flt-1 target sequence
aaaatggagccaggcctggaa

SEQ ID NO: 764 - DNA, 21 bp, Artificial Sequence
  Flt-1 target sequence
aaatggagccaggcctggaac

SEQ ID NO: 765 - DNA, 21 bp, Artificial Sequence
  Flt-1 target sequence
aatggagccaggcctggaaca

SEQ ID NO: 766 - DNA, 21 bp, Artificial Sequence
  Flt-1 target sequence
aacaaggcaagaaaccaagac

SEQ ID NO: 767 - DNA, 21 bp, Artificial Sequence
  Flt-1 target sequence
aaggcaagaaaccaagactag

SEQ ID NO: 768 - DNA, 21 bp, Artificial Sequence
  Flt-1 target sequence
aagaaaccaagactagatagc

SEQ ID NO: 769 - DNA, 21 bp, Artificial Sequence
  Flt-1 target sequence
aaaccaagactagatagcgtc

SEQ ID NO: 770 - DNA, 21 bp, Artificial Sequence
  Flt-1 target sequence
aaccaagactagatagcgtca

SEQ ID NO: 771 - DNA, 21 bp, Artificial Sequence
  Flt-1 target sequence
aagactagatagcgtcaccag

SEQ ID NO: 772 - DNA, 21 bp, Artificial Sequence
  Flt-1 target sequence
aaagctttgcgagctccggct

SEQ ID NO: 773 - DNA, 20 bp, Artificial Sequence
  Flt-1 target sequence
aagctttgcgagctccggct

SEQ ID NO: 774 - DNA, 21 bp, Artificial Sequence
  Flt-1 target sequence
aagataaaagtctgagtgatg

SEQ ID NO: 775 - DNA, 21 bp, Artificial Sequence
  Flt-1 target sequence
aaaagtctgagtgatgttgag

SEQ ID NO: 776 - DNA, 21 bp, Artificial Sequence
  Flt-1 target sequence
aaagtctgagtgatgttgagg

SEQ ID NO: 777 - DNA, 21 bp, Artificial Sequence
  Flt-1 target sequence
aagtctgagtgatgttgagga

SEQ ID NO: 778 - DNA, 21 bp, Artificial Sequence
  Flt-1 target sequence
aagaggaggattctgacggtt

SEQ ID NO: 779 - DNA, 21 bp, Artificial Sequence
  Flt-1 target sequence
aaggagcccatcactatggaa

SEQ ID NO: 780 - DNA, 21 bp, Artificial Sequence
  Flt-1 target sequence
aagatctgatttcttacagtt

SEQ ID NO: 781 - DNA, 21 bp, Artificial Sequence
  Flt-1 target sequence
aagtggccagaggcatggagt

SEQ ID NO: 782 - DNA, 21 bp, Artificial Sequence
  Flt-1 target sequence
aaagtgcattcatcgggacct

SEQ ID NO: 783 - DNA, 21 bp, Artificial Sequence
  Flt-1 target sequence
aagtgcattcatcgggacctg

SEQ ID NO: 784 - DNA, 21 bp, Artificial Sequence
  Flt-1 target sequence
aaacattcttttatctgagaa

SEQ ID NO: 785 - DNA, 21 bp, Artificial Sequence
  Flt-1 target sequence
aacattcttttatctgagaac

SEQ ID NO: 786 - DNA, 21 bp, Artificial Sequence
  Flt-1 target sequence
aacaacgtggtgaagatttgt

SEQ ID NO: 787 - DNA, 21 bp, Artificial Sequence
  Flt-1 target sequence
aacgtggtgaagatttgtgat

SEQ ID NO: 788 - DNA, 21 bp, Artificial Sequence
  Flt-1 target sequence
aagatttgtgattttggcctt

SEQ ID NO: 789 - DNA, 21 bp, Artificial Sequence
  Flt-1 target sequence
aagaaccccgattatgtgaga

SEQ ID NO: 790 - DNA, 21 bp, Artificial Sequence
  Flt-1 target sequence
aaccccgattatgtgagaaaa

SEQ ID NO: 791 - DNA, 21 bp, Artificial Sequence
  Flt-1 target sequence
aaaaggagatactcgacttcc

SEQ ID NO: 792 - DNA, 21 bp, Artificial Sequence
  Flt-1 target sequence
aaaggagatactcgacttcct

SEQ ID NO: 793 - DNA, 21 bp, Artificial Sequence
  Flt-1 target sequence
aaggagatactcgacttcctc

SEQ ID NO: 794 - DNA, 21 bp, Artificial Sequence
  Flt-1 target sequence
aaatggatggctcctgaatct

SEQ ID NO: 795 - DNA, 21 bp, Artificial Sequence
  Flt-1 target sequence
aatggatggctcctgaatcta

SEQ ID NO: 796 - DNA, 21 bp, Artificial Sequence
  Flt-1 target sequence
aatctatctttgacaaaatct

SEQ ID NO: 797 - DNA, 21 bp, Artificial Sequence
  Flt-1 target sequence
aaaatctacagcaccaagagc

SEQ ID NO: 798 - DNA, 21 bp, Artificial Sequence
  Flt-1 target sequence
aaatctacagcaccaagagcg

SEQ ID NO: 799 - DNA, 21 bp, Artificial Sequence
  Flt-1 target sequence
aatctacagcaccaagagcga

SEQ ID NO: 800 - DNA, 21 bp, Artificial Sequence
  Flt-1 target sequence
aagagcgacgtgtggtcttac

SEQ ID NO: 801 - DNA, 21 bp, Artificial Sequence
  Flt-1 target sequence
aaatcttctccttaggtgggt

SEQ ID NO: 802 - DNA, 21 bp, Artificial Sequence
  Flt-1 target sequence
aatcttctccttaggtgggtc

SEQ ID NO: 803 - DNA, 21 bp, Artificial Sequence
  Flt-1 target sequence
aaatggatgaggacttttgca

SEQ ID NO: 804 - DNA, 21 bp, Artificial Sequence
  Flt-1 target sequence
aatggatgaggacttttgcag

SEQ ID NO: 805 - DNA, 21 bp, Artificial Sequence
  Flt-1 target sequence
aaggcatgaggatgagagctc

SEQ ID NO: 806 - DNA, 21 bp, Artificial Sequence
  Flt-1 target sequence
aaatctatcagatcatgctgg

SEQ ID NO: 807 - DNA, 21 bp, Artificial Sequence
  Flt-1 target sequence
aatctatcagatcatgctgga

SEQ ID NO: 808 - DNA, 21 bp, Artificial Sequence
  Flt-1 target sequence
aaaagaaaggccaagatttgc

SEQ ID NO: 809 - DNA, 21 bp, Artificial Sequence
  Flt-1 target sequence
aaagaaaggccaagatttgca

SEQ ID NO: 810 - DNA, 21 bp, Artificial Sequence
  Flt-1 target sequence
aagaaaggccaagatttgcag

SEQ ID NO: 811 - DNA, 21 bp, Artificial Sequence
  Flt-1 target sequence
aaaggccaagatttgcagaac

SEQ ID NO: 812 - DNA, 21 bp, Artificial Sequence
  Flt-1 target sequence
aaggccaagatttgcagaact

SEQ ID NO: 813 - DNA, 21 bp, Artificial Sequence
  Flt-1 target sequence
aagatttgcagaacttgtgga

SEQ ID NO: 814 - DNA, 21 bp, Artificial Sequence
  Flt-1 target sequence
aacttgtggaaaaactaggtg

SEQ ID NO: 815 - DNA, 21 bp, Artificial Sequence
  Flt-1 target sequence
aaaaactaggtgatttgcttc

SEQ ID NO: 816 - DNA, 21 bp, Artificial Sequence
  Flt-1 target sequence
aaaactaggtgatttgcttca

SEQ ID NO: 817 - DNA, 21 bp, Artificial Sequence
  Flt-1 target sequence
aaactaggtgatttgcttcaa

SEQ ID NO: 818 - DNA, 21 bp, Artificial Sequence
  Flt-1 target sequence
aactaggtgatttgcttcaag

SEQ ID NO: 819 - DNA, 21 bp, Artificial Sequence
  Flt-1 target sequence
aagcaaatgtacaacaggatg

SEQ ID NO: 820 - DNA, 21 bp, Artificial Sequence
  Flt-1 target sequence
aaatgtacaacaggatggtaa

SEQ ID NO: 821 - DNA, 21 bp, Artificial Sequence
  Flt-1 target sequence
aatgtacaacaggatggtaaa

SEQ ID NO: 822 - DNA, 21 bp, Artificial Sequence
  Flt-1 target sequence
aacaggatggtaaagactaca

SEQ ID NO: 823 - DNA, 21 bp, Artificial Sequence
  Flt-1 target sequence
aaagactacatcccaatcaat

SEQ ID NO: 824 - DNA, 21 bp, Artificial Sequence
  Flt-1 target sequence
aagactacatcccaatcaatg

SEQ ID NO: 825 - DNA, 21 bp, Artificial Sequence
  Flt-1 target sequence
aatcaatgccatactgacagg

SEQ ID NO: 826 - DNA, 21 bp, Artificial Sequence
  Flt-1 target sequence
aatgccatactgacaggaaat

SEQ ID NO: 827 - DNA, 21 bp, Artificial Sequence
  Flt-1 target sequence
aaatagtgggtttacatactc

SEQ ID NO: 828 - DNA, 21 bp, Artificial Sequence
  Flt-1 target sequence
aatagtgggtttacatactca

SEQ ID NO: 829 - DNA, 21 bp, Artificial Sequence
  Flt-1 target sequence
aactcctgccttctctgagga

SEQ ID NO: 830 - DNA, 21 bp, Artificial Sequence
  Flt-1 target sequence
aaggaaagtatttcagctccg

SEQ ID NO: 831 - DNA, 21 bp, Artificial Sequence
  Flt-1 target sequence
aaagtatttcagctccgaagt

SEQ ID NO: 832 - DNA, 21 bp, Artificial Sequence
  Flt-1 target sequence
aagtatttcagctccgaagtt

SEQ ID NO: 833 - DNA, 21 bp, Artificial Sequence
  Flt-1 target sequence
aagtttaattcaggaagctct

SEQ ID NO: 834 - DNA, 21 bp, Artificial Sequence
  Flt-1 target sequence
aattcaggaagctctgatgat

SEQ ID NO: 835 - DNA, 21 bp, Artificial Sequence
  Flt-1 target sequence
aagctctgatgatgtcagata

SEQ ID NO: 836 - DNA, 21 bp, Artificial Sequence
  Flt-1 target sequence
aaatgctttcaagttcatgag

SEQ ID NO: 837 - DNA, 21 bp, Artificial Sequence
  Flt-1 target sequence
aatgctttcaagttcatgagc

SEQ ID NO: 838 - DNA, 21 bp, Artificial Sequence
  Flt-1 target sequence
aagttcatgagcctggaaaga

SEQ ID NO: 839 - DNA, 21 bp, Artificial Sequence
  Flt-1 target sequence
aaagaatcaaaacctttgaag

SEQ ID NO: 840 - DNA, 21 bp, Artificial Sequence
  Flt-1 target sequence
aagaatcaaaacctttgaaga

SEQ ID NO: 841 - DNA, 21 bp, Artificial Sequence
  Flt-1 target sequence
aatcaaaacctttgaagaact

SEQ ID NO: 842 - DNA, 21 bp, Artificial Sequence
  Flt-1 target sequence
aaaacctttgaagaactttta

SEQ ID NO: 843 - DNA, 21 bp, Artificial Sequence
  Flt-1 target sequence
aaacctttgaagaacttttac

SEQ ID NO: 844 - DNA, 21 bp, Artificial Sequence
  Flt-1 target sequence
aacctttgaagaacttttacc

SEQ ID NO: 845 - DNA, 21 bp, Artificial Sequence
  Flt-1 target sequence
aagaacttttaccgaatgcca

SEQ ID NO: 846 - DNA, 21 bp, Artificial Sequence
  Flt-1 target sequence
aacttttaccgaatgccacct

SEQ ID NO: 847 - DNA, 21 bp, Artificial Sequence
  Flt-1 target sequence
aatgccacctccatgtttgat

SEQ ID NO: 848 - DNA, 21 bp, Artificial Sequence
  Flt-1 target sequence
aaacccaaggcctcgctcaag

SEQ ID NO: 849 - DNA, 21 bp, Artificial Sequence
  Flt-1 target sequence
aaacccaaggcctcgctcaag

SEQ ID NO: 850 - DNA, 21 bp, Artificial Sequence
  Flt-1 target sequence
aacccaaggcctcgctcaaga

SEQ ID NO: 851 - DNA, 21 bp, Artificial Sequence
  Flt-1 target sequence
aaggcctcgctcaagattgac

SEQ ID NO: 852 - DNA, 21 bp, Artificial Sequence
  Flt-1 target sequence
aagattgacttgagagtaacc

SEQ ID NO: 853 - DNA, 21 bp, Artificial Sequence
  Flt-1 target sequence
aaccagtaaaagtaaggagtc

SEQ ID NO: 854 - DNA, 21 bp, Artificial Sequence
  Flt-1 target sequence
aaaagtaaggagtcggggctg

SEQ ID NO: 855 - DNA, 21 bp, Artificial Sequence
  Flt-1 target sequence
aaagtaaggagtcggggctgt

SEQ ID NO: 856 - DNA, 21 bp, Artificial Sequence
  Flt-1 target sequence
aagtaaggagtcggggctgtc

SEQ ID NO: 857 - DNA, 21 bp, Artificial Sequence
  Flt-1 target sequence
aaggagtcggggctgtctgat

SEQ ID NO: 858 - DNA, 21 bp, Artificial Sequence
  Flt-1 target sequence
aaggcaagcgcaggttcacct

SEQ ID NO: 859 - DNA, 21 bp, Artificial Sequence
  Flt-1 target sequence
gcacccagcacatcatgcaag

SEQ ID NO: 860 - DNA, 21 bp, Artificial Sequence
  Flt-1 target sequence
ggctgagcataactaaatctg

SEQ ID NO: 861 - DNA, 21 bp, Artificial Sequence
  Flt-1 target sequence
gcttctacagctgcaaatatc

SEQ ID NO: 862 - DNA, 21 bp, Artificial Sequence
  Flt-1 target sequence
gagctcgtcattccctgccgg

SEQ ID NO: 863 - DNA, 21 bp, Artificial Sequence
  Flt-1 target sequence
ccaaagcaattcccatgccaa

SEQ ID NO: 864 - DNA, 21 bp, Artificial Sequence
  Flt-1 target sequence
tgctgagcataaaacagtcaa

SEQ ID NO: 865 - DNA, 21 bp, Artificial Sequence
  Flt-1 target sequence
ttgcatagcttccaataaagt

SEQ ID NO: 866 - DNA, 21 bp, Artificial Sequence
  Flt-1 target sequence
agtgatcacacagtggccatc

SEQ ID NO: 867 - DNA, 21 bp, Artificial Sequence
  Flt-1 target sequence
gatgaagttcctttggatgag

SEQ ID NO: 868 - DNA, 21 bp, Artificial Sequence
  Flt-1 target sequence
tacacatggagcctaagaaag

SEQ ID NO: 869 - DNA, 21 bp, Artificial Sequence
  Flt-1 target sequence
gagctccggctttcaggaaga

SEQ ID NO: 870 - DNA, 21 bp, Artificial Sequence
  Flt-1 target sequence
tctacagcaccaagagcgacg

SEQ ID NO: 871 - DNA, 21 bp, Artificial Sequence
  Flt-1 target sequence
tctgatgatgtcagatatgta

SEQ ID NO: 872 - DNA, 21 bp, Artificial Sequence
  Flt-1 target sequence
gcctcgctcaagattgacttg

SEQ ID NO: 873 - DNA, 21 bp, Artificial Sequence
  Flk-1/KDR-1 target sequence
aaaaagacatacttacaatta

SEQ ID NO: 874 - DNA, 21 bp, Artificial Sequence
  Flk-1/KDR-1 target sequence
aaaagacatacttacaattaa

SEQ ID NO: 875 - DNA, 21 bp, Artificial Sequence
  Flk-1/KDR-1 target sequence
aaagacatacttacaattaag

SEQ ID NO: 876 - DNA, 21 bp, Artificial Sequence
  Flk-1/KDR-1 target sequence
aagacatacttacaattaagg

SEQ ID NO: 877 - DNA, 21 bp, Artificial Sequence
  Flk-1/KDR-1 target sequence
aattaaggctaatacaactct

SEQ ID NO: 878 - DNA, 21 bp, Artificial Sequence
  Flk-1/KDR-1 target sequence
aaggctaatacaactcttcaa

SEQ ID NO: 879 - DNA, 21 bp, Artificial Sequence
  Flk-1/KDR-1 target sequence
aatacaactcttcaaattact

SEQ ID NO: 880 - DNA, 21 bp, Artificial Sequence
  Flk-1/KDR-1 target sequence
aactcttcaaattacttgcag

SEQ ID NO: 881 - DNA, 21 bp, Artificial Sequence
  Flk-1/KDR-1 target sequence
aaattacttgcaggggacaga

SEQ ID NO: 882 - DNA, 21 bp, Artificial Sequence
  Flk-1/KDR-1 target sequence
aattacttgcaggggacagag

SEQ ID NO: 883 - DNA, 21 bp, Artificial Sequence
  Flk-1/KDR-1 target sequence
aataatcagagtggcagtgag

SEQ ID NO: 884 - DNA, 21 bp, Artificial Sequence
  Flk-1/KDR-1 target sequence
aatcagagtggcagtgagcaa

SEQ ID NO: 885 - DNA, 21 bp, Artificial Sequence
  Flk-1/KDR-1 target sequence
aaagggtggaggtgactgagt

SEQ ID NO: 886 - DNA, 21 bp, Artificial Sequence
  Flk-1/KDR-1 target sequence
aagggtggaggtgactgagtg

SEQ ID NO: 887 - DNA, 21 bp, Artificial Sequence
  Flk-1/KDR-1 target sequence
aagacactcacaattccaaaa

SEQ ID NO: 888 - DNA, 21 bp, Artificial Sequence
  Flk-1/KDR-1 target sequence
aattccaaaagtgatcggaaa

SEQ ID NO: 889 - DNA, 21 bp, Artificial Sequence
  Flk-1/KDR-1 target sequence
aaaagtgatcggaaatgacac

SEQ ID NO: 890 - DNA, 21 bp, Artificial Sequence
  Flk-1/KDR-1 target sequence
aaagtgatcggaaatgacact

SEQ ID NO: 891 - DNA, 21 bp, Artificial Sequence
  Flk-1/KDR-1 target sequence
aagtgatcggaaatgacactg

SEQ ID NO: 892 - DNA, 21 bp, Artificial Sequence
  Flk-1/KDR-1 target sequence
aaatgacactggagcctacaa

SEQ ID NO: 893 - DNA, 21 bp, Artificial Sequence
  Flk-1/KDR-1 target sequence
aatgacactggagcctacaag

SEQ ID NO: 894 - DNA, 21 bp, Artificial Sequence
  Flk-1/KDR-1 target sequence
aagtgcttctaccgggaaact

SEQ ID NO: 895 - DNA, 21 bp, Artificial Sequence
  Flk-1/KDR-1 target sequence
aaactgacttggcctcggtca

SEQ ID NO: 896 - DNA, 21 bp, Artificial Sequence
  Flk-1/KDR-1 target sequence
aactgacttggcctcggtcat

SEQ ID NO: 897 - DNA, 21 bp, Artificial Sequence
  Flk-1/KDR-1 target sequence
aagattacagatctccattta

SEQ ID NO: 898 - DNA, 21 bp, Artificial Sequence
  Flk-1/KDR-1 target sequence
aacatggagtcgtgtacatta

SEQ ID NO: 899 - DNA, 21 bp, Artificial Sequence
  Flk-1/KDR-1 target sequence
aacaaaaacaaaactgtggtg

SEQ ID NO: 900 - DNA, 21 bp, Artificial Sequence
  Flk-1/KDR-1 target sequence
aaaaacaaaactgtggtgatt

SEQ ID NO: 901 - DNA, 21 bp, Artificial Sequence
  Flk-1/KDR-1 target sequence
aaaacaaaactgtggtgattc

SEQ ID NO: 902 - DNA, 21 bp, Artificial Sequence
  Flk-1/KDR-1 target sequence
aaacaaaactgtggtgattcc

SEQ ID NO: 903 - DNA, 21 bp, Artificial Sequence
  Flk-1/KDR-1 target sequence
aacaaaactgtggtgattcca

SEQ ID NO: 904 - DNA, 21 bp, Artificial Sequence
  Flk-1/KDR-1 target sequence
aaaactgtggtgattccatgt

SEQ ID NO: 905 - DNA, 21 bp, Artificial Sequence
  Flk-1/KDR-1 target sequence
aaactgtggtgattccatgtc

SEQ ID NO: 906 - DNA, 21 bp, Artificial Sequence
  Flk-1/KDR-1 target sequence
aactgtggtgattccatgtct

SEQ ID NO: 907 - DNA, 21 bp, Artificial Sequence
  Flk-1/KDR-1 target sequence
aaatctcaacgtgtcactttg

SEQ ID NO: 908 - DNA, 21 bp, Artificial Sequence
  Flk-1/KDR-1 target sequence
aatctcaacgtgtcactttgt

SEQ ID NO: 909 - DNA, 21 bp, Artificial Sequence
  Flk-1/KDR-1 target sequence
aacgtgtcactttgtgcaaga

SEQ ID NO: 910 - DNA, 21 bp, Artificial Sequence
  Flk-1/KDR-1 target sequence
aagatacccagaaaagagatt

SEQ ID NO: 911 - DNA, 21 bp, Artificial Sequence
  Flk-1/KDR-1 target sequence
aaaagagatttgttcctgatg

SEQ ID NO: 912 - DNA, 21 bp, Artificial Sequence
  Flk-1/KDR-1 target sequence
aaagagatttgttcctgatgg

SEQ ID NO: 913 - DNA, 21 bp, Artificial Sequence
  Flk-1/KDR-1 target sequence
aagagatttgttcctgatggt

SEQ ID NO: 914 - DNA, 21 bp, Artificial Sequence
  Flk-1/KDR-1 target sequence
aacagaatttcctgggacagc

SEQ ID NO: 915 - DNA, 21 bp, Artificial Sequence
  Flk-1/KDR-1 target sequence
aatttcctgggacagcaagaa

SEQ ID NO: 916 - DNA, 21 bp, Artificial Sequence
  Flk-1/KDR-1 target sequence
aagaagggctttactattccc

SEQ ID NO: 917 - DNA, 21 bp, Artificial Sequence
  Flk-1/KDR-1 target sequence
aagggctttactattcccagc

SEQ ID NO: 918 - DNA, 21 bp, Artificial Sequence
  Flk-1/KDR-1 target sequence
aagcaaaaattaatgatgaaa

SEQ ID NO: 919 - DNA, 21 bp, Artificial Sequence
  Flk-1/KDR-1 target sequence
aaaaattaatgatgaaagtta

SEQ ID NO: 920 - DNA, 21 bp, Artificial Sequence
  Flk-1/KDR-1 target sequence
aaaattaatgatgaaagttac

SEQ ID NO: 921 - DNA, 21 bp, Artificial Sequence
  Flk-1/KDR-1 target sequence
aaattaatgatgaaagttacc

SEQ ID NO: 922 - DNA, 21 bp, Artificial Sequence
  Flk-1/KDR-1 target sequence
aattaatgatgaaagttacca

SEQ ID NO: 923 - DNA, 21 bp, Artificial Sequence
  Flk-1/KDR-1 target sequence
aatgatgaaagttaccagtct

SEQ ID NO: 924 - DNA, 21 bp, Artificial Sequence
  Flk-1/KDR-1 target sequence
aaagttaccagtctattatgt

SEQ ID NO: 925 - DNA, 21 bp, Artificial Sequence
  Flk-1/KDR-1 target sequence
aagttaccagtctattatgta

SEQ ID NO: 926 - DNA, 21 bp, Artificial Sequence
  Flk-1/KDR-1 target sequence
aattgaactatctgttggaga

SEQ ID NO: 927 - DNA, 21 bp, Artificial Sequence
  Flk-1/KDR-1 target sequence
aactatctgttggagaaaagc

SEQ ID NO: 928 - DNA, 21 bp, Artificial Sequence
  Flk-1/KDR-1 target sequence
aaaagcttgtcttaaattgta

SEQ ID NO: 929 - DNA, 21 bp, Artificial Sequence
  Flk-1/KDR-1 target sequence
aaagcttgtcttaaattgtac

SEQ ID NO: 930 - DNA, 21 bp, Artificial Sequence
  Flk-1/KDR-1 target sequence
aagcttgtcttaaattgtaca

SEQ ID NO: 931 - DNA, 21 bp, Artificial Sequence
  Flk-1/KDR-1 target sequence
aaattgtacagcaagaactga

SEQ ID NO: 932 - DNA, 21 bp, Artificial Sequence
  Flk-1/KDR-1 target sequence
aattgtacagcaagaactgaa

SEQ ID NO: 933 - DNA, 21 bp, Artificial Sequence
  Flk-1/KDR-1 target sequence
aagaactgaactaaatgtggg

SEQ ID NO: 934 - DNA, 21 bp, Artificial Sequence
  Flk-1/KDR-1 target sequence
aactgaactaaatgtggggat

SEQ ID NO: 935 - DNA, 21 bp, Artificial Sequence
  Flk-1/KDR-1 target sequence
aactaaatgtggggattgact

SEQ ID NO: 936 - DNA, 21 bp, Artificial Sequence
  Flk-1/KDR-1 target sequence
aaatgtggggattgacttcaa

SEQ ID NO: 937 - DNA, 21 bp, Artificial Sequence
  Flk-1/KDR-1 target sequence
aatgtggggattgacttcaac

SEQ ID NO: 938 - DNA, 21 bp, Artificial Sequence
  Flk-1/KDR-1 target sequence
aactgggaatacccttcttcg

SEQ ID NO: 939 - DNA, 21 bp, Artificial Sequence
  Flk-1/KDR-1 target sequence
aatacccttcttcgaagcatc

SEQ ID NO: 940 - DNA, 21 bp, Artificial Sequence
  Flk-1/KDR-1 target sequence
aagcatcagcataagaaactt

SEQ ID NO: 941 - DNA, 21 bp, Artificial Sequence
  Flk-1/KDR-1 target sequence
aagaaacttgtaaaccgagac

SEQ ID NO: 942 - DNA, 21 bp, Artificial Sequence
  Flk-1/KDR-1 target sequence
aaacttgtaaaccgagaccta

SEQ ID NO: 943 - DNA, 21 bp, Artificial Sequence
  Flk-1/KDR-1 target sequence
aacttgtaaaccgagacctaa

SEQ ID NO: 944 - DNA, 21 bp, Artificial Sequence
  Flk-1/KDR-1 target sequence
aaaccgagacctaaaaaccca

SEQ ID NO: 945 - DNA, 21 bp, Artificial Sequence
  Flk-1/KDR-1 target sequence
aaccgagacctaaaaacccag

SEQ ID NO: 946 - DNA, 21 bp, Artificial Sequence
  Flk-1/KDR-1 target sequence
aaaaacccagtctgggagtga

SEQ ID NO: 947 - DNA, 21 bp, Artificial Sequence
  Flk-1/KDR-1 target sequence
aaaacccagtctgggagtgag

SEQ ID NO: 948 - DNA, 21 bp, Artificial Sequence
  Flk-1/KDR-1 target sequence
aaacccagtctgggagtgaga

SEQ ID NO: 949 - DNA, 21 bp, Artificial Sequence
  Flk-1/KDR-1 target sequence
aacccagtctgggagtgagat

SEQ ID NO: 950 - DNA, 21 bp, Artificial Sequence
  Flk-1/KDR-1 target sequence
aagaaatttttgagcacctta

SEQ ID NO: 951 - DNA, 21 bp, Artificial Sequence
  Flk-1/KDR-1 target sequence
aaatttttgagcaccttaact

SEQ ID NO: 952 - DNA, 21 bp, Artificial Sequence
  Flk-1/KDR-1 target sequence
aatttttgagcaccttaacta

SEQ ID NO: 953 - DNA, 21 bp, Artificial Sequence
  Flk-1/KDR-1 target sequence
aactatagatggtgtaacccg

SEQ ID NO: 954 - DNA, 21 bp, Artificial Sequence
  Flk-1/KDR-1 target sequence
aacccggagtgaccaaggatt

SEQ ID NO: 955 - DNA, 21 bp, Artificial Sequence
  Flk-1/KDR-1 target sequence
aaggattgtacacctgtgcag

SEQ ID NO: 956 - DNA, 21 bp, Artificial Sequence
  Flk-1/KDR-1 target sequence
aagaagaacagcacatttgtc

SEQ ID NO: 957 - DNA, 21 bp, Artificial Sequence
  Flk-1/KDR-1 target sequence
aagaacagcacatttgtcagg

SEQ ID NO: 958 - DNA, 21 bp, Artificial Sequence
  Flk-1/KDR-1 target sequence
aacagcacatttgtcagggtc

SEQ ID NO: 959 - DNA, 21 bp, Artificial Sequence
  Flk-1/KDR-1 target sequence
aaaaaccttttgttgcttttg

SEQ ID NO: 960 - DNA, 21 bp, Artificial Sequence
  Flk-1/KDR-1 target sequence
aaaaccttttgttgcttttgg

SEQ ID NO: 961 - DNA, 21 bp, Artificial Sequence
  Flk-1/KDR-1 target sequence
aaaccttttgttgcttttgga

SEQ ID NO: 962 - DNA, 21 bp, Artificial Sequence
  Flk-1/KDR-1 target sequence
aaccttttgttgcttttggaa

SEQ ID NO: 963 - DNA, 21 bp, Artificial Sequence
  Flk-1/KDR-1 target sequence
aagtggcatggaatctctggt

SEQ ID NO: 964 - DNA, 21 bp, Artificial Sequence
  Flk-1/KDR-1 target sequence
aatctctggtggaagccacgg

SEQ ID NO: 965 - DNA, 21 bp, Artificial Sequence
  Flk-1/KDR-1 target sequence
aagccacggtgggggagcgtg

SEQ ID NO: 966 - DNA, 21 bp, Artificial Sequence
  Flk-1/KDR-1 target sequence
aatccctgcgaagtaccttgg

SEQ ID NO: 967 - DNA, 21 bp, Artificial Sequence
  Flk-1/KDR-1 target sequence
aagtaccttggttacccaccc

SEQ ID NO: 968 - DNA, 21 bp, Artificial Sequence
  Flk-1/KDR-1 target sequence
aaataaaatggtataaaaatg

SEQ ID NO: 969 - DNA, 21 bp, Artificial Sequence
  Flk-1/KDR-1 target sequence
aataaaatggtataaaaatgg

SEQ ID NO: 970 - DNA, 21 bp, Artificial Sequence
  Flk-1/KDR-1 target sequence
aaaatggtataaaaatggaat

SEQ ID NO: 971 - DNA, 21 bp, Artificial Sequence
  Flk-1/KDR-1 target sequence
aaatggtataaaaatggaata

SEQ ID NO: 972 - DNA, 21 bp, Artificial Sequence
  Flk-1/KDR-1 target sequence
aatggtataaaaatggaatac

SEQ ID NO: 973 - DNA, 21 bp, Artificial Sequence
  Flk-1/KDR-1 target sequence
aaaaatggaataccccttgag

SEQ ID NO: 974 - DNA, 21 bp, Artificial Sequence
  Flk-1/KDR-1 target sequence
aaaatggaataccccttgagt

SEQ ID NO: 975 - DNA, 21 bp, Artificial Sequence
  Flk-1/KDR-1 target sequence
aaatggaataccccttgagtc

SEQ ID NO: 976 - DNA, 21 bp, Artificial Sequence
  Flk-1/KDR-1 target sequence
aatggaataccccttgagtcc

SEQ ID NO: 977 - DNA, 21 bp, Artificial Sequence
  Flk-1/KDR-1 target sequence
aataccccttgagtccaatca

SEQ ID NO: 978 - DNA, 21 bp, Artificial Sequence
  Flk-1/KDR-1 target sequence
aatcacacaattaaagcgggg

SEQ ID NO: 979 - DNA, 21 bp, Artificial Sequence
  Flk-1/KDR-1 target sequence
aattaaagcggggcatgtact

SEQ ID NO: 980 - DNA, 21 bp, Artificial Sequence
  Flk-1/KDR-1 target sequence
aaagcggggcatgtactgacg

SEQ ID NO: 981 - DNA, 21 bp, Artificial Sequence
  Flk-1/KDR-1 target sequence
aagcggggcatgtactgacga

SEQ ID NO: 982 - DNA, 21 bp, Artificial Sequence
  Flk-1/KDR-1 target sequence
aagtgagtgaaagagacacag

SEQ ID NO: 983 - DNA, 21 bp, Artificial Sequence
  Flk-1/KDR-1 target sequence
aaagagacacaggaaattaca

SEQ ID NO: 984 - DNA, 21 bp, Artificial Sequence
  Flk-1/KDR-1 target sequence
aagagacacaggaaattacac

SEQ ID NO: 985 - DNA, 21 bp, Artificial Sequence
  Flk-1/KDR-1 target sequence
aaattacactgtcatccttac

SEQ ID NO: 986 - DNA, 21 bp, Artificial Sequence
  Flk-1/KDR-1 target sequence
aattacactgtcatccttacc

SEQ ID NO: 987 - DNA, 21 bp, Artificial Sequence
  Flk-1/KDR-1 target sequence
aatcccatttcaaaggagaag

SEQ ID NO: 988 - DNA, 21 bp, Artificial Sequence
  Flk-1/KDR-1 target sequence
aaaggagaagcagagccatgt

SEQ ID NO: 989 - DNA, 21 bp, Artificial Sequence
  Flk-1/KDR-1 target sequence
aaggagaagcagagccatgtg

SEQ ID NO: 990 - DNA, 21 bp, Artificial Sequence
  Flk-1/KDR-1 target sequence
aagcagagccatgtggtctct

SEQ ID NO: 991 - DNA, 21 bp, Artificial Sequence
  Flk-1/KDR-1 target sequence
aaatctctaatctctcctgtg

SEQ ID NO: 992 - DNA, 21 bp, Artificial Sequence
  Flk-1/KDR-1 target sequence
aatctctaatctctcctgtgg

SEQ ID NO: 993 - DNA, 21 bp, Artificial Sequence
  Flk-1/KDR-1 target sequence
aatctctcctgtggattccta

SEQ ID NO: 994 - DNA, 21 bp, Artificial Sequence
  Flk-1/KDR-1 target sequence
aaacgctgacatgtacggtct

SEQ ID NO: 995 - DNA, 21 bp, Artificial Sequence
  Flk-1/KDR-1 target sequence
aacgctgacatgtacggtcta

SEQ ID NO: 996 - DNA, 21 bp, Artificial Sequence
  Flk-1/KDR-1 target sequence
aagagtgcgccaacgagccca

SEQ ID NO: 997 - DNA, 21 bp, Artificial Sequence
  Flk-1/KDR-1 target sequence
aacgagcccagccaagctgtc

SEQ ID NO: 998 - DNA, 21 bp, Artificial Sequence
  Flk-1/KDR-1 target sequence
aagctgtctcagtgacaaacc

SEQ ID NO: 999 - DNA, 21 bp, Artificial Sequence
  Flk-1/KDR-1 target sequence
aaacccatacccttgtgaaga

SEQ ID NO: 1000 - DNA, 21 bp, Artificial Sequence
  Flk-1/KDR-1 target sequence
aacccatacccttgtgaagaa

SEQ ID NO: 1001 - DNA, 21 bp, Artificial Sequence
  Flk-1/KDR-1 target sequence
aagaatggagaagtgtggagg

SEQ ID NO: 1002 - DNA, 21 bp, Artificial Sequence
  Flk-1/KDR-1 target sequence
aatggagaagtgtggaggact

SEQ ID NO: 1003 - DNA, 21 bp, Artificial Sequence
  Flk-1/KDR-1 target sequence
aagtgtggaggacttccaggg

SEQ ID NO: 1004 - DNA, 21 bp, Artificial Sequence
  Flk-1/KDR-1 target sequence
aaataaaattgaagttaataa

SEQ ID NO: 1005 - DNA, 21 bp, Artificial Sequence
  Flk-1/KDR-1 target sequence
aataaaattgaagttaataaa

SEQ ID NO: 1006 - DNA, 21 bp, Artificial Sequence
  Flk-1/KDR-1 target sequence
aaaattgaagttaataaaaat

SEQ ID NO: 1007 - DNA, 21 bp, Artificial Sequence
  Flk-1/KDR-1 target sequence
aaattgaagttaataaaaatc

SEQ ID NO: 1008 - DNA, 21 bp, Artificial Sequence
  Flk-1/KDR-1 target sequence
aattgaagttaataaaaatca

SEQ ID NO: 1009 - DNA, 21 bp, Artificial Sequence
  Flk-1/KDR-1 target sequence
aagttaataaaaatcaatttg

SEQ ID NO: 1010 - DNA, 21 bp, Artificial Sequence
  Flk-1/KDR-1 target sequence
aataaaaatcaatttgctcta

SEQ ID NO: 1011 - DNA, 21 bp, Artificial Sequence
  Flk-1/KDR-1 target sequence
aaaaatcaatttgctctaatt

SEQ ID NO: 1012 - DNA, 21 bp, Artificial Sequence
  Flk-1/KDR-1 target sequence
aaaatcaatttgctctaattg

SEQ ID NO: 1013 - DNA, 21 bp, Artificial Sequence
  Flk-1/KDR-1 target sequence
aaatcaatttgctctaattga

SEQ ID NO: 1014 - DNA, 21 bp, Artificial Sequence
  Flk-1/KDR-1 target sequence
aatcaatttgctctaattgaa

SEQ ID NO: 1015 - DNA, 21 bp, Artificial Sequence
  Flk-1/KDR-1 target sequence
aatttgctctaattgaaggaa

SEQ ID NO: 1016 - DNA, 21 bp, Artificial Sequence
  Flk-1/KDR-1 target sequence
aattgaaggaaaaaacaaaac

SEQ ID NO: 1017 - DNA, 21 bp, Artificial Sequence
  Flk-1/KDR-1 target sequence
aaggaaaaaacaaaactgtaa

SEQ ID NO: 1018 - DNA, 21 bp, Artificial Sequence
  Flk-1/KDR-1 target sequence
aaaaaacaaaactgtaagtac

SEQ ID NO: 1019 - DNA, 21 bp, Artificial Sequence
  Flk-1/KDR-1 target sequence
aaaaacaaaactgtaagtacc

SEQ ID NO: 1020 - DNA, 21 bp, Artificial Sequence
  Flk-1/KDR-1 target sequence
aaaacaaaactgtaagtaccc

SEQ ID NO: 1021 - DNA, 21 bp, Artificial Sequence
  Flk-1/KDR-1 target sequence
aaacaaaactgtaagtaccct

SEQ ID NO: 1022 - DNA, 21 bp, Artificial Sequence
  Flk-1/KDR-1 target sequence
aacaaaactgtaagtaccctt

SEQ ID NO: 1023 - DNA, 21 bp, Artificial Sequence
  Flk-1/KDR-1 target sequence
aaaactgtaagtacccttgtt

SEQ ID NO: 1024 - DNA, 21 bp, Artificial Sequence
  Flk-1/KDR-1 target sequence
aaactgtaagtacccttgtta

SEQ ID NO: 1025 - DNA, 21 bp, Artificial Sequence
  Flk-1/KDR-1 target sequence
aactgtaagtacccttgttat

SEQ ID NO: 1026 - DNA, 21 bp, Artificial Sequence
  Flk-1/KDR-1 target sequence
aagtacccttgttatccaagc

SEQ ID NO: 1027 - DNA, 21 bp, Artificial Sequence
  Flk-1/KDR-1 target sequence
aagcggcaaatgtgtcagctt

SEQ ID NO: 1028 - DNA, 21 bp, Artificial Sequence
  Flk-1/KDR-1 target sequence
aaatgtgtcagctttgtacaa

SEQ ID NO: 1029 - DNA, 21 bp, Artificial Sequence
  Flk-1/KDR-1 target sequence
aatgtgtcagctttgtacaaa

SEQ ID NO: 1030 - DNA, 21 bp, Artificial Sequence
  Flk-1/KDR-1 target sequence
aaatgtgaagcggtcaacaaa

SEQ ID NO: 1031 - DNA, 21 bp, Artificial Sequence
  Flk-1/KDR-1 target sequence
aatgtgaagcggtcaacaaag

SEQ ID NO: 1032 - DNA, 21 bp, Artificial Sequence
  Flk-1/KDR-1 target sequence
aagcggtcaacaaagtcggga

SEQ ID NO: 1033 - DNA, 21 bp, Artificial Sequence
  Flk-1/KDR-1 target sequence
aacaaagtcgggagaggagag

SEQ ID NO: 1034 - DNA, 21 bp, Artificial Sequence
  Flk-1/KDR-1 target sequence
aaagtcgggagaggagagagg

SEQ ID NO: 1035 - DNA, 21 bp, Artificial Sequence
  Flk-1/KDR-1 target sequence
aagtcgggagaggagagaggg

SEQ ID NO: 1036 - DNA, 21 bp, Artificial Sequence
  Flk-1/KDR-1 target sequence
aaattactttgcaacctgaca

SEQ ID NO: 1037 - DNA, 21 bp, Artificial Sequence
  Flk-1/KDR-1 target sequence
aattactttgcaacctgacat

SEQ ID NO: 1038 - DNA, 21 bp, Artificial Sequence
  Flk-1/KDR-1 target sequence
aacctgacatgcagcccactg

SEQ ID NO: 1039 - DNA, 21 bp, Artificial Sequence
  Flk-1/KDR-1 target sequence
aacctcacatggtacaagctt

SEQ ID NO: 1040 - DNA, 21 bp, Artificial Sequence
  Flk-1/KDR-1 target sequence
aagcttggcccacagcctctg

SEQ ID NO: 1041 - DNA, 21 bp, Artificial Sequence
  Flk-1/KDR-1 target sequence
aatccatgtgggagagttgcc

SEQ ID NO: 1042 - DNA, 21 bp, Artificial Sequence
  Flk-1/KDR-1 target sequence
aagaacttggatactctttgg

SEQ ID NO: 1043 - DNA, 21 bp, Artificial Sequence
  Flk-1/KDR-1 target sequence
aacttggatactctttggaaa

SEQ ID NO: 1044 - DNA, 21 bp, Artificial Sequence
  Flk-1/KDR-1 target sequence
aaattgaatgccaccatgttc

SEQ ID NO: 1045 - DNA, 21 bp, Artificial Sequence
  Flk-1/KDR-1 target sequence
aattgaatgccaccatgttct

SEQ ID NO: 1046 - DNA, 21 bp, Artificial Sequence
  Flk-1/KDR-1 target sequence
aatgccaccatgttctctaat

SEQ ID NO: 1047 - DNA, 21 bp, Artificial Sequence
  Flk-1/KDR-1 target sequence
aatagcacaaatgacattttg

SEQ ID NO: 1048 - DNA, 21 bp, Artificial Sequence
  Flk-1/KDR-1 target sequence
aaatgacattttgatcatgga

SEQ ID NO: 1049 - DNA, 21 bp, Artificial Sequence
  Flk-1/KDR-1 target sequence
aatgacattttgatcatggag

SEQ ID NO: 1050 - DNA, 21 bp, Artificial Sequence
  Flk-1/KDR-1 target sequence
aagaatgcatccttgcaggac

SEQ ID NO: 1051 - DNA, 21 bp, Artificial Sequence
  Flk-1/KDR-1 target sequence
aatgcatccttgcaggaccaa

SEQ ID NO: 1052 - DNA, 21 bp, Artificial Sequence
  Flk-1/KDR-1 target sequence
aaggagactatgtctgccttg

SEQ ID NO: 1053 - DNA, 21 bp, Artificial Sequence
  Flk-1/KDR-1 target sequence
aagacaggaagaccaagaaaa

SEQ ID NO: 1054 - DNA, 21 bp, Artificial Sequence
  Flk-1/KDR-1 target sequence
aagaccaagaaaagacattgc

SEQ ID NO: 1055 - DNA, 21 bp, Artificial Sequence
  Flk-1/KDR-1 target sequence
aagaaaagacattgcgtggtc

SEQ ID NO: 1056 - DNA, 21 bp, Artificial Sequence
  Flk-1/KDR-1 target sequence
aaaagacattgcgtggtcagg

SEQ ID NO: 1057 - DNA, 21 bp, Artificial Sequence
  Flk-1/KDR-1 target sequence
aaagacattgcgtggtcaggc

SEQ ID NO: 1058 - DNA, 21 bp, Artificial Sequence
  Flk-1/KDR-1 target sequence
aagacattgcgtggtcaggca

SEQ ID NO: 1059 - DNA, 21 bp, Artificial Sequence
  Flk-1/KDR-1 target sequence
aaacctggagaatcagacgac

SEQ ID NO: 1060 - DNA, 21 bp, Artificial Sequence
  Flk-1/KDR-1 target sequence
aacctggagaatcagacgaca

SEQ ID NO: 1061 - DNA, 21 bp, Artificial Sequence
  Flk-1/KDR-1 target sequence
aatcagacgacaagtattggg

SEQ ID NO: 1062 - DNA, 21 bp, Artificial Sequence
  Flk-1/KDR-1 target sequence
aagtattggggaaagcatcga

SEQ ID NO: 1063 - DNA, 21 bp, Artificial Sequence
  Flk-1/KDR-1 target sequence
aaagcatcgaagtctcatgca

SEQ ID NO: 1064 - DNA, 21 bp, Artificial Sequence
  Flk-1/KDR-1 target sequence
aagcatcgaagtctcatgcac

SEQ ID NO: 1065 - DNA, 21 bp, Artificial Sequence
  Flk-1/KDR-1 target sequence
aatccccctccacagatcatg

SEQ ID NO: 1066 - DNA, 21 bp, Artificial Sequence
  Flk-1/KDR-1 target sequence
aaagataatgagacccttgta

SEQ ID NO: 1067 - DNA, 21 bp, Artificial Sequence
  Flk-1/KDR-1 target sequence
aagataatgagacccttgtag

SEQ ID NO: 1068 - DNA, 21 bp, Artificial Sequence
  Flk-1/KDR-1 target sequence
aatgagacccttgtagaagac

SEQ ID NO: 1069 - DNA, 21 bp, Artificial Sequence
  Flk-1/KDR-1 target sequence
aagactcaggcattgtattga

SEQ ID NO: 1070 - DNA, 21 bp, Artificial Sequence
  Flk-1/KDR-1 target sequence
aaggatgggaaccggaacctc

SEQ ID NO: 1071 - DNA, 21 bp, Artificial Sequence
  Flk-1/KDR-1 target sequence
aaccggaacctcactatccgc

SEQ ID NO: 1072 - DNA, 21 bp, Artificial Sequence
  Flk-1/KDR-1 target sequence
aacctcactatccgcagagtg

SEQ ID NO: 1073 - DNA, 21 bp, Artificial Sequence
  Flk-1/KDR-1 target sequence
aaggaggacgaaggcctctac

SEQ ID NO: 1074 - DNA, 21 bp, Artificial Sequence
  Flk-1/KDR-1 target sequence
aaggcctctacacctgccagg

SEQ ID NO: 1075 - DNA, 21 bp, Artificial Sequence
  Flk-1/KDR-1 target sequence
aaaagtggaggcatttttcat

SEQ ID NO: 1076 - DNA, 21 bp, Artificial Sequence
  Flk-1/KDR-1 target sequence
aaagtggaggcatttttcata

SEQ ID NO: 1077 - DNA, 21 bp, Artificial Sequence
  Flk-1/KDR-1 target sequence
aagtggaggcatttttcataa

SEQ ID NO: 1078 - DNA, 21 bp, Artificial Sequence
  Flk-1/KDR-1 target sequence
aatagaaggtgcccaggaaaa

SEQ ID NO: 1079 - DNA, 21 bp, Artificial Sequence
  Flk-1/KDR-1 target sequence
aaggtgcccaggaaaagacga

SEQ ID NO: 1080 - DNA, 21 bp, Artificial Sequence
  Flk-1/KDR-1 target sequence
aaaagacgaacttggaaatca

SEQ ID NO: 1081 - DNA, 21 bp, Artificial Sequence
  Flk-1/KDR-1 target sequence
aaagacgaacttggaaatcat

SEQ ID NO: 1082 - DNA, 21 bp, Artificial Sequence
  Flk-1/KDR-1 target sequence
aagacgaacttggaaatcatt

SEQ ID NO: 1083 - DNA, 21 bp, Artificial Sequence
  Flk-1/KDR-1 target sequence
aacttggaaatcattattcta

SEQ ID NO: 1084 - DNA, 21 bp, Artificial Sequence
  Flk-1/KDR-1 target sequence
aaatcattattctagtaggca

SEQ ID NO: 1085 - DNA, 21 bp, Artificial Sequence
  Flk-1/KDR-1 target sequence
aatcattattctagtaggcac

SEQ ID NO: 1086 - DNA, 21 bp, Artificial Sequence
  Flk-1/KDR-1 target sequence
aagcgggccaatggaggggaa

SEQ ID NO: 1087 - DNA, 21 bp, Artificial Sequence
  Flk-1/KDR-1 target sequence
aatggaggggaactgaagaca

SEQ ID NO: 1088 - DNA, 21 bp, Artificial Sequence
  Flk-1/KDR-1 target sequence
aactgaagacaggctacttgt

SEQ ID NO: 1089 - DNA, 21 bp, Artificial Sequence
  Flk-1/KDR-1 target sequence
aagacaggctacttgtccatc

SEQ ID NO: 1090 - DNA, 21 bp, Artificial Sequence
  Flk-1/KDR-1 target sequence
aactcccattggatgaacatt

SEQ ID NO: 1091 - DNA, 21 bp, Artificial Sequence
  Flk-1/KDR-1 target sequence
aacattgtgaacgactgcctt

SEQ ID NO: 1092 - DNA, 21 bp, Artificial Sequence
  Flk-1/KDR-1 target sequence
aacgactgccttatgatgcca

SEQ ID NO: 1093 - DNA, 21 bp, Artificial Sequence
  Flk-1/KDR-1 target sequence
aaatgggaattccccagagac

SEQ ID NO: 1094 - DNA, 21 bp, Artificial Sequence
  Flk-1/KDR-1 target sequence
aatgggaattccccagagacc

SEQ ID NO: 1095 - DNA, 21 bp, Artificial Sequence
  Flk-1/KDR-1 target sequence
aattccccagagaccggctga

SEQ ID NO: 1096 - DNA, 21 bp, Artificial Sequence
  Flk-1/KDR-1 target sequence
aagctaggtaagcctcttggc

SEQ ID NO: 1097 - DNA, 21 bp, Artificial Sequence
  Flk-1/KDR-1 target sequence
aagcctcttggccgtggtgcc

SEQ ID NO: 1098 - DNA, 21 bp, Artificial Sequence
  Flk-1/KDR-1 target sequence
aagtgattgaagcagatgcct

SEQ ID NO: 1099 - DNA, 21 bp, Artificial Sequence
  Flk-1/KDR-1 target sequence
aagcagatgcctttggaattg

SEQ ID NO: 1100 - DNA, 21 bp, Artificial Sequence
  Flk-1/KDR-1 target sequence
aattgacaagacagcaacttg

SEQ ID NO: 1101 - DNA, 21 bp, Artificial Sequence
  Flk-1/KDR-1 target sequence
aagacagcaacttgcaggaca

SEQ ID NO: 1102 - DNA, 21 bp, Artificial Sequence
  Flk-1/KDR-1 target sequence
aacttgcaggacagtagcagt

SEQ ID NO: 1103 - DNA, 21 bp, Artificial Sequence
  Flk-1/KDR-1 target sequence
aaaatgttgaaagaaggagca

SEQ ID NO: 1104 - DNA, 21 bp, Artificial Sequence
  Flk-1/KDR-1 target sequence
aaatgttgaaagaaggagcaa

SEQ ID NO: 1105 - DNA, 21 bp, Artificial Sequence
  Flk-1/KDR-1 target sequence
aatgttgaaagaaggagcaac

SEQ ID NO: 1106 - DNA, 21 bp, Artificial Sequence
  Flk-1/KDR-1 target sequence
aaagaaggagcaacacacagt

SEQ ID NO: 1107 - DNA, 21 bp, Artificial Sequence
  Flk-1/KDR-1 target sequence
aagaaggagcaacacacagtg

SEQ ID NO: 1108 - DNA, 21 bp, Artificial Sequence
  Flk-1/KDR-1 target sequence
aaggagcaacacacagtgagc

SEQ ID NO: 1109 - DNA, 21 bp, Artificial Sequence
  Flk-1/KDR-1 target sequence
aacacacagtgagcatcgagc

SEQ ID NO: 1110 - DNA, 21 bp, Artificial Sequence
  Flk-1/KDR-1 target sequence
aactcaagatcctcattcata

SEQ ID NO: 1111 - DNA, 21 bp, Artificial Sequence
  Flk-1/KDR-1 target sequence
aagatcctcattcatattggt

SEQ ID NO: 1112 - DNA, 21 bp, Artificial Sequence
  Flk-1/KDR-1 target sequence
aatgtggtcaaccttctaggt

SEQ ID NO: 1113 - DNA, 21 bp, Artificial Sequence
  Flk-1/KDR-1 target sequence
aaccttctaggtgcctgtacc

SEQ ID NO: 1114 - DNA, 21 bp, Artificial Sequence
  Flk-1/KDR-1 target sequence
aagccaggagggccactcatg

SEQ ID NO: 1115 - DNA, 21 bp, Artificial Sequence
  Flk-1/KDR-1 target sequence
aattctgcaaatttggaaacc

SEQ ID NO: 1116 - DNA, 21 bp, Artificial Sequence
  Flk-1/KDR-1 target sequence
aaatttggaaacctgtccact

SEQ ID NO: 1117 - DNA, 21 bp, Artificial Sequence
  Flk-1/KDR-1 target sequence
aatttggaaacctgtccactt

SEQ ID NO: 1118 - DNA, 21 bp, Artificial Sequence
  Flk-1/KDR-1 target sequence
aaacctgtccacttacctgag

SEQ ID NO: 1119 - DNA, 21 bp, Artificial Sequence
  Flk-1/KDR-1 target sequence
aacctgtccacttacctgagg

SEQ ID NO: 1120 - DNA, 21 bp, Artificial Sequence
  Flk-1/KDR-1 target sequence
aagagaaatgaatttgtcccc

SEQ ID NO: 1121 - DNA, 21 bp, Artificial Sequence
  Flk-1/KDR-1 target sequence
aaatgaatttgtcccctacaa

SEQ ID NO: 1122 - DNA, 21 bp, Artificial Sequence
  Flk-1/KDR-1 target sequence
aatgaatttgtcccctacaag

SEQ ID NO: 1123 - DNA, 21 bp, Artificial Sequence
  Flk-1/KDR-1 target sequence
aatttgtcccctacaagacca

SEQ ID NO: 1124 - DNA, 21 bp, Artificial Sequence
  Flk-1/KDR-1 target sequence
aagaccaaaggggcacgattc

SEQ ID NO: 1125 - DNA, 21 bp, Artificial Sequence
  Flk-1/KDR-1 target sequence
aaaggggcacgattccgtcaa

SEQ ID NO: 1126 - DNA, 21 bp, Artificial Sequence
  Flk-1/KDR-1 target sequence
aaggggcacgattccgtcaag

SEQ ID NO: 1127 - DNA, 21 bp, Artificial Sequence
  Flk-1/KDR-1 target sequence
aagggaaagactacgttggag

SEQ ID NO: 1128 - DNA, 21 bp, Artificial Sequence
  Flk-1/KDR-1 target sequence
aaagactacgttggagcaatc

SEQ ID NO: 1129 - DNA, 21 bp, Artificial Sequence
  Flk-1/KDR-1 target sequence
aagactacgttggagcaatcc

SEQ ID NO: 1130 - DNA, 21 bp, Artificial Sequence
  Flk-1/KDR-1 target sequence
aatccctgtggatctgaaacg

SEQ ID NO: 1131 - DNA, 21 bp, Artificial Sequence
  Flk-1/KDR-1 target sequence
aaacggcgcttggacagcatc

SEQ ID NO: 1132 - DNA, 21 bp, Artificial Sequence
  Flk-1/KDR-1 target sequence
aacggcgcttggacagcatca

SEQ ID NO: 1133 - DNA, 21 bp, Artificial Sequence
  Flk-1/KDR-1 target sequence
aagtccctcagtgatgtagaa

SEQ ID NO: 1134 - DNA, 21 bp, Artificial Sequence
  Flk-1/KDR-1 target sequence
aagaagaggaagctcctgaag

SEQ ID NO: 1135 - DNA, 21 bp, Artificial Sequence
  Flk-1/KDR-1 target sequence
aagaggaagctcctgaagatc

SEQ ID NO: 1136 - DNA, 21 bp, Artificial Sequence
  Flk-1/KDR-1 target sequence
aagctcctgaagatctgtata

SEQ ID NO: 1137 - DNA, 21 bp, Artificial Sequence
  Flk-1/KDR-1 target sequence
aagatctgtataaggacttcc

SEQ ID NO: 1138 - DNA, 21 bp, Artificial Sequence
  Flk-1/KDR-1 target sequence
aaggacttcctgaccttggag

SEQ ID NO: 1139 - DNA, 21 bp, Artificial Sequence
  Flk-1/KDR-1 target sequence
aagtggctaagggcatggagt

SEQ ID NO: 1140 - DNA, 21 bp, Artificial Sequence
  Flk-1/KDR-1 target sequence
aagggcatggagttcttggca

SEQ ID NO: 1141 - DNA, 21 bp, Artificial Sequence
  Flk-1/KDR-1 target sequence
aaagtgtatccacagggacct

SEQ ID NO: 1142 - DNA, 21 bp, Artificial Sequence
  Flk-1/KDR-1 target sequence
aagtgtatccacagggacctg

SEQ ID NO: 1143 - DNA, 21 bp, Artificial Sequence
  Flk-1/KDR-1 target sequence
aaatatcctcttatcggagaa

SEQ ID NO: 1144 - DNA, 21 bp, Artificial Sequence
  Flk-1/KDR-1 target sequence
aatatcctcttatcggagaag

SEQ ID NO: 1145 - DNA, 21 bp, Artificial Sequence
  Flk-1/KDR-1 target sequence
aatatcctcttatcggagaag

SEQ ID NO: 1146 - DNA, 21 bp, Artificial Sequence
  Flk-1/KDR-1 target sequence
aagaacgtggttaaaatctgt

SEQ ID NO: 1147 - DNA, 21 bp, Artificial Sequence
  Flk-1/KDR-1 target sequence
aacgtggttaaaatctgtgac

SEQ ID NO: 1148 - DNA, 21 bp, Artificial Sequence
  Flk-1/KDR-1 target sequence
aaaatctgtgactttggcttg

SEQ ID NO: 1149 - DNA, 21 bp, Artificial Sequence
  Flk-1/KDR-1 target sequence
aaatctgtgactttggcttgg

SEQ ID NO: 1150 - DNA, 21 bp, Artificial Sequence
  Flk-1/KDR-1 target sequence
aatctgtgactttggcttggc

SEQ ID NO: 1151 - DNA, 21 bp, Artificial Sequence
  Flk-1/KDR-1 target sequence
aaagatccagattatgtcaga

SEQ ID NO: 1152 - DNA, 21 bp, Artificial Sequence
  Flk-1/KDR-1 target sequence
aagatccagattatgtcagaa

SEQ ID NO: 1153 - DNA, 21 bp, Artificial Sequence
  Flk-1/KDR-1 target sequence
aaaaggagatgctcgcctccc

SEQ ID NO: 1154 - DNA, 21 bp, Artificial Sequence
  Flk-1/KDR-1 target sequence
aaaggagatgctcgcctccct

SEQ ID NO: 1155 - DNA, 21 bp, Artificial Sequence
  Flk-1/KDR-1 target sequence
aaggagatgctcgcctccctt

SEQ ID NO: 1156 - DNA, 21 bp, Artificial Sequence
  Flk-1/KDR-1 target sequence
aaatggatggccccagaaaca

SEQ ID NO: 1157 - DNA, 21 bp, Artificial Sequence
  Flk-1/KDR-1 target sequence
aatggatggccccagaaacaa

SEQ ID NO: 1158 - DNA, 21 bp, Artificial Sequence
  Flk-1/KDR-1 target sequence
aaacaatttttgacagagtgt

SEQ ID NO: 1159 - DNA, 21 bp, Artificial Sequence
  Flk-1/KDR-1 target sequence
aacaatttttgacagagtgta

SEQ ID NO: 1160 - DNA, 21 bp, Artificial Sequence
  Flk-1/KDR-1 target sequence
aatttttgacagagtgtacac

SEQ ID NO: 1161 - DNA, 21 bp, Artificial Sequence
  Flk-1/KDR-1 target sequence
aatccagagtgacgtctggtc

SEQ ID NO: 1162 - DNA, 21 bp, Artificial Sequence
  Flk-1/KDR-1 target sequence
aaatattttccttaggtgctt

SEQ ID NO: 1163 - DNA, 21 bp, Artificial Sequence
  Flk-1/KDR-1 target sequence
aatattttccttaggtgcttc

SEQ ID NO: 1164 - DNA, 21 bp, Artificial Sequence
  Flk-1/KDR-1 target sequence
aaagattgatgaagaattttg

SEQ ID NO: 1165 - DNA, 21 bp, Artificial Sequence
  Flk-1/KDR-1 target sequence
aagattgatgaagaattttgt

SEQ ID NO: 1166 - DNA, 21 bp, Artificial Sequence
  Flk-1/KDR-1 target sequence
aagaattttgtaggcgattga

SEQ ID NO: 1167 - DNA, 21 bp, Artificial Sequence
  Flk-1/KDR-1 target sequence
aattttgtaggcgattgaaag

SEQ ID NO: 1168 - DNA, 21 bp, Artificial Sequence
  Flk-1/KDR-1 target sequence
aaagaaggaactagaatgagg

SEQ ID NO: 1169 - DNA, 21 bp, Artificial Sequence
  Flk-1/KDR-1 target sequence
aagaaggaactagaatgaggg

SEQ ID NO: 1170 - DNA, 21 bp, Artificial Sequence
  Flk-1/KDR-1 target sequence
aaggaactagaatgagggccc

SEQ ID NO: 1171 - DNA, 21 bp, Artificial Sequence
  Flk-1/KDR-1 target sequence
aactagaatgagggcccctga

SEQ ID NO: 1172 - DNA, 21 bp, Artificial Sequence
  Flk-1/KDR-1 target sequence
aatgagggcccctgattatac

SEQ ID NO: 1173 - DNA, 21 bp, Artificial Sequence
  Flk-1/KDR-1 target sequence
aaatgtaccagaccatgctgg

SEQ ID NO: 1174 - DNA, 21 bp, Artificial Sequence
  Flk-1/KDR-1 target sequence
aatgtaccagaccatgctgga

SEQ ID NO: 1175 - DNA, 21 bp, Artificial Sequence
  Flk-1/KDR-1 target sequence
aacatttgggaaatctcttgc

SEQ ID NO: 1176 - DNA, 21 bp, Artificial Sequence
  Flk-1/KDR-1 target sequence
aaatctcttgcaagctaatgc

SEQ ID NO: 1177 - DNA, 21 bp, Artificial Sequence
  Flk-1/KDR-1 target sequence
aatctcttgcaagctaatgct

SEQ ID NO: 1178 - DNA, 21 bp, Artificial Sequence
  Flk-1/KDR-1 target sequence
aagctaatgctcagcaggatg

SEQ ID NO: 1179 - DNA, 21 bp, Artificial Sequence
  Flk-1/KDR-1 target sequence
aatgctcagcaggatggcaaa

SEQ ID NO: 1180 - DNA, 21 bp, Artificial Sequence
  Flk-1/KDR-1 target sequence
aaagactacattgttcttccg

SEQ ID NO: 1181 - DNA, 21 bp, Artificial Sequence
  Flk-1/KDR-1 target sequence
aagactacattgttcttccga

SEQ ID NO: 1182 - DNA, 21 bp, Artificial Sequence
  Flk-1/KDR-1 target sequence
aagaggattctggactctctc

SEQ ID NO: 1183 - DNA, 21 bp, Artificial Sequence
  Flk-1/KDR-1 target sequence
aagtatgtgaccccaaattcc

SEQ ID NO: 1184 - DNA, 21 bp, Artificial Sequence
  Flk-1/KDR-1 target sequence
aaattccattatgacaacaca

SEQ ID NO: 1185 - DNA, 21 bp, Artificial Sequence
  Flk-1/KDR-1 target sequence
aattccattatgacaacacag

SEQ ID NO: 1186 - DNA, 21 bp, Artificial Sequence
  Flk-1/KDR-1 target sequence
aacacagcaggaatcagtcag

SEQ ID NO: 1187 - DNA, 21 bp, Artificial Sequence
  Flk-1/KDR-1 target sequence
aatcagtcagtatctgcagaa

SEQ ID NO: 1188 - DNA, 21 bp, Artificial Sequence
  Flk-1/KDR-1 target sequence
aacagtaagcgaaagagccgg

SEQ ID NO: 1189 - DNA, 21 bp, Artificial Sequence
  Flk-1/KDR-1 target sequence
aagcgaaagagccggcctgtg

SEQ ID NO: 1190 - DNA, 21 bp, Artificial Sequence
  Flk-1/KDR-1 target sequence
aaagagccggcctgtgagtgt

SEQ ID NO: 1191 - DNA, 21 bp, Artificial Sequence
  Flk-1/KDR-1 target sequence
aagagccggcctgtgagtgta

SEQ ID NO: 1192 - DNA, 21 bp, Artificial Sequence
  Flk-1/KDR-1 target sequence
aaaaacatttgaagatatccc

SEQ ID NO: 1193 - DNA, 21 bp, Artificial Sequence
  Flk-1/KDR-1 target sequence
aaaacatttgaagatatcccg

SEQ ID NO: 1194 - DNA, 21 bp, Artificial Sequence
  Flk-1/KDR-1 target sequence
aaacatttgaagatatcccgt

SEQ ID NO: 1195 - DNA, 21 bp, Artificial Sequence
  Flk-1/KDR-1 target sequence
aacatttgaagatatcccgtt

SEQ ID NO: 1196 - DNA, 21 bp, Artificial Sequence
  Flk-1/KDR-1 target sequence
aagatatcccgttagaagaac

SEQ ID NO: 1197 - DNA, 21 bp, Artificial Sequence
  Flk-1/KDR-1 target sequence
aagaaccagaagtaaaagtaa

SEQ ID NO: 1198 - DNA, 21 bp, Artificial Sequence
  Flk-1/KDR-1 target sequence
aaccagaagtaaaagtaatcc

SEQ ID NO: 1199 - DNA, 21 bp, Artificial Sequence
  Flk-1/KDR-1 target sequence
aagtaaaagtaatcccagatg

SEQ ID NO: 1200 - DNA, 21 bp, Artificial Sequence
  Flk-1/KDR-1 target sequence
aaaagtaatcccagatgacaa

SEQ ID NO: 1201 - DNA, 21 bp, Artificial Sequence
  Flk-1/KDR-1 target sequence
aaagtaatcccagatgacaac

SEQ ID NO: 1202 - DNA, 21 bp, Artificial Sequence
  Flk-1/KDR-1 target sequence
aagtaatcccagatgacaacc

SEQ ID NO: 1203 - DNA, 21 bp, Artificial Sequence
  Flk-1/KDR-1 target sequence
aatcccagatgacaaccagac

SEQ ID NO: 1204 - DNA, 21 bp, Artificial Sequence
  Flk-1/KDR-1 target sequence
aaccagacggacagtggtatg

SEQ ID NO: 1205 - DNA, 21 bp, Artificial Sequence
  Flk-1/KDR-1 target sequence
aagagctgaaaactttggaag

SEQ ID NO: 1206 - DNA, 21 bp, Artificial Sequence
  Flk-1/KDR-1 target sequence
aaaactttggaagacagaacc

SEQ ID NO: 1207 - DNA, 21 bp, Artificial Sequence
  Flk-1/KDR-1 target sequence
aaactttggaagacagaacca

SEQ ID NO: 1208 - DNA, 21 bp, Artificial Sequence
  Flk-1/KDR-1 target sequence
aactttggaagacagaaccaa

SEQ ID NO: 1209 - DNA, 21 bp, Artificial Sequence
  Flk-1/KDR-1 target sequence
aagacagaaccaaattatctc

SEQ ID NO: 1210 - DNA, 21 bp, Artificial Sequence
  Flk-1/KDR-1 target sequence
aaccaaattatctccatcttt

SEQ ID NO: 1211 - DNA, 21 bp, Artificial Sequence
  Flk-1/KDR-1 target sequence
aaattatctccatcttttggt

SEQ ID NO: 1212 - DNA, 21 bp, Artificial Sequence
  Flk-1/KDR-1 target sequence
aattatctccatcttttggtg

SEQ ID NO: 1213 - DNA, 21 bp, Artificial Sequence
  Flk-1/KDR-1 target sequence
aatggtgcccagcaaaagcag

SEQ ID NO: 1214 - DNA, 21 bp, Artificial Sequence
  Flk-1/KDR-1 target sequence
aaaagcagggagtctgtggca

SEQ ID NO: 1215 - DNA, 21 bp, Artificial Sequence
  Flk-1/KDR-1 target sequence
aaagcagggagtctgtggcat

SEQ ID NO: 1216 - DNA, 21 bp, Artificial Sequence
  Flk-1/KDR-1 target sequence
aagcagggagtctgtggcatc

SEQ ID NO: 1217 - DNA, 21 bp, Artificial Sequence
  Flk-1/KDR-1 target sequence
aaggctcaaaccagacaagcg

SEQ ID NO: 1218 - DNA, 21 bp, Artificial Sequence
  Flk-1/KDR-1 target sequence
aaaccagacaagcggctacca

SEQ ID NO: 1219 - DNA, 21 bp, Artificial Sequence
  Flk-1/KDR-1 target sequence
aaccagacaagcggctaccag

SEQ ID NO: 1220 - DNA, 21 bp, Artificial Sequence
  Flk-1/KDR-1 target sequence
aagcggctaccagtccggata

SEQ ID NO: 1221 - DNA, 21 bp, Artificial Sequence
  Flk-1/KDR-1 target sequence
aagcagaacttttaaagctga

SEQ ID NO: 1222 - DNA, 21 bp, Artificial Sequence
  Flk-1/KDR-1 target sequence
gacatacttacaattaaggct

SEQ ID NO: 1223 - DNA, 21 bp, Artificial Sequence
  Flk-1/KDR-1 target sequence
gatttgttcctgatggtaaca

SEQ ID NO: 1224 - DNA, 21 bp, Artificial Sequence
  Flk-1/KDR-1 target sequence
ttttgagcaccttaactatag

SEQ ID NO: 1225 - DNA, 21 bp, Artificial Sequence
  Flk-1/KDR-1 target sequence
gagccatgtggtctctctggt

SEQ ID NO: 1226 - DNA, 21 bp, Artificial Sequence
  Flk-1/KDR-1 target sequence
ggtgatctccttccacgtgac

SEQ ID NO: 1227 - DNA, 21 bp, Artificial Sequence
  Flk-1/KDR-1 target sequence
gtggtcaggcagctcacagtc

SEQ ID NO: 1228 - DNA, 21 bp, Artificial Sequence
  Flk-1/KDR-1 target sequence
cggtgattgccatgttcttct

SEQ ID NO: 1229 - DNA, 21 bp, Artificial Sequence
  Flk-1/KDR-1 target sequence
ttctaggtgcctgtaccaagc

SEQ ID NO: 1230 - DNA, 21 bp, Artificial Sequence
  Flk-1/KDR-1 target sequence
tgtatccacagggacctggcg

SEQ ID NO: 1231 - DNA, 21 bp, Artificial Sequence
  Flk-1/KDR-1 target sequence
taccagaccatgctggactgc

SEQ ID NO: 1232 - DNA, 21 bp, Artificial Sequence
  Flk-1/KDR-1 target sequence
ttatctccatcttttggtgga

SEQ ID NO: 1233 - DNA, 21 bp, Artificial Sequence
  ICAM-1 target sequence
aatgcccagacatctgtgtcc

SEQ ID NO: 1234 - DNA, 21 bp, Artificial Sequence
  ICAM-1 target sequence
aaaagtcatcctgccccgggg

SEQ ID NO: 1235 - DNA, 21 bp, Artificial Sequence
  ICAM-1 target sequence
aaagtcatcctgccccgggga

SEQ ID NO: 1236 - DNA, 21 bp, Artificial Sequence
  ICAM-1 target sequence
aagtcatcctgccccggggag

SEQ ID NO: 1237 - DNA, 21 bp, Artificial Sequence
  ICAM-1 target sequence
aagttgttgggcatagagacc

SEQ ID NO: 1238 - DNA, 21 bp, Artificial Sequence
  ICAM-1 target sequence
aaaaaggagttgctcctgcct

SEQ ID NO: 1239 - DNA, 21 bp, Artificial Sequence
  ICAM-1 target sequence
aaaaggagttgctcctgcctg

SEQ ID NO: 1240 - DNA, 21 bp, Artificial Sequence
  ICAM-1 target sequence
aaaggagttgctcctgcctgg

SEQ ID NO: 1241 - DNA, 21 bp, Artificial Sequence
  ICAM-1 target sequence
aaggagttgctcctgcctggg

SEQ ID NO: 1242 - DNA, 21 bp, Artificial Sequence
  ICAM-1 target sequence
aacaaccggaaggtgtatgaa

SEQ ID NO: 1243 - DNA, 21 bp, Artificial Sequence
  ICAM-1 target sequence
aaccggaaggtgtatgaactg

SEQ ID NO: 1244 - DNA, 21 bp, Artificial Sequence
  ICAM-1 target sequence
aaggtgtatgaactgagcaat

SEQ ID NO: 1245 - DNA, 21 bp, Artificial Sequence
  ICAM-1 target sequence
aactgagcaatgtgcaagaag

SEQ ID NO: 1246 - DNA, 21 bp, Artificial Sequence
  ICAM-1 target sequence
aatgtgcaagaagatagccaa

SEQ ID NO: 1247 - DNA, 21 bp, Artificial Sequence
  ICAM-1 target sequence
aagaagatagccaaccaatgt

SEQ ID NO: 1248 - DNA, 21 bp, Artificial Sequence
  ICAM-1 target sequence
aagatagccaaccaatgtgct

SEQ ID NO: 1249 - DNA, 21 bp, Artificial Sequence
  ICAM-1 target sequence
aaccaatgtgctattcaaact

SEQ ID NO: 1250 - DNA, 21 bp, Artificial Sequence
  ICAM-1 target sequence
aatgtgctattcaaactgccc

SEQ ID NO: 1251 - DNA, 21 bp, Artificial Sequence
  ICAM-1 target sequence
aaactgccctgatgggcagtc

SEQ ID NO: 1252 - DNA, 21 bp, Artificial Sequence
  ICAM-1 target sequence
aactgccctgatgggcagtca

SEQ ID NO: 1253 - DNA, 21 bp, Artificial Sequence
  ICAM-1 target sequence
aacagctaaaaccttcctcac

SEQ ID NO: 1254 - DNA, 21 bp, Artificial Sequence
  ICAM-1 target sequence
aaaaccttcctcaccgtgtac

SEQ ID NO: 1255 - DNA, 21 bp, Artificial Sequence
  ICAM-1 target sequence
aaaccttcctcaccgtgtact

SEQ ID NO: 1256 - DNA, 21 bp, Artificial Sequence
  ICAM-1 target sequence
aaccttcctcaccgtgtactg

SEQ ID NO: 1257 - DNA, 21 bp, Artificial Sequence
  ICAM-1 target sequence
aacgggtggaactggcacccc

SEQ ID NO: 1258 - DNA, 21 bp, Artificial Sequence
  ICAM-1 target sequence
aactggcacccctcccctctt

SEQ ID NO: 1259 - DNA, 21 bp, Artificial Sequence
  ICAM-1 target sequence
aagaaccttaccctacgctgc

SEQ ID NO: 1260 - DNA, 21 bp, Artificial Sequence
  ICAM-1 target sequence
aaccttaccctacgctgccag

SEQ ID NO: 1261 - DNA, 21 bp, Artificial Sequence
  ICAM-1 target sequence
aacctcaccgtggtgctgctc

SEQ ID NO: 1262 - DNA, 21 bp, Artificial Sequence
  ICAM-1 target sequence
aaggagctgaaacgggagcca

SEQ ID NO: 1263 - DNA, 21 bp, Artificial Sequence
  ICAM-1 target sequence
aaacgggagccagctgtgggg

SEQ ID NO: 1264 - DNA, 21 bp, Artificial Sequence
  ICAM-1 target sequence
aacgggagccagctgtggggg

SEQ ID NO: 1265 - DNA, 21 bp, Artificial Sequence
  ICAM-1 target sequence
aatttctcgtgccgcactgaa

SEQ ID NO: 1266 - DNA, 21 bp, Artificial Sequence
  ICAM-1 target sequence
aactggacctgcggccccaag

SEQ ID NO: 1267 - DNA, 21 bp, Artificial Sequence
  ICAM-1 target sequence
aagggctggagctgtttgaga

SEQ ID NO: 1268 - DNA, 21 bp, Artificial Sequence
  ICAM-1 target sequence
aacacctcggccccctaccag

SEQ ID NO: 1269 - DNA, 21 bp, Artificial Sequence
  ICAM-1 target sequence
aacttgtcagcccccgggtcc

SEQ ID NO: 1270 - DNA, 21 bp, Artificial Sequence
  ICAM-1 target sequence
aaccccacagtcacctatggc

SEQ ID NO: 1271 - DNA, 21 bp, Artificial Sequence
  ICAM-1 target sequence
aacgactccttctcggccaag

SEQ ID NO: 1272 - DNA, 21 bp, Artificial Sequence
  ICAM-1 target sequence
aaggcctcagtcagtgtgacc

SEQ ID NO: 1273 - DNA, 21 bp, Artificial Sequence
  ICAM-1 target sequence
aatactggggaaccagagcca

SEQ ID NO: 1274 - DNA, 21 bp, Artificial Sequence
  ICAM-1 target sequence
aaccagagccaggagacactg

SEQ ID NO: 1275 - DNA, 21 bp, Artificial Sequence
  ICAM-1 target sequence
aacgtgattctgacgaagcca

SEQ ID NO: 1276 - DNA, 21 bp, Artificial Sequence
  ICAM-1 target sequence
aagccagaggtctcagaaggg

SEQ ID NO: 1277 - DNA, 21 bp, Artificial Sequence
  ICAM-1 target sequence
aagggaccgaggtgacagtga

SEQ ID NO: 1278 - DNA, 21 bp, Artificial Sequence
  ICAM-1 target sequence
aagtgtgaggcccaccctaga

SEQ ID NO: 1279 - DNA, 21 bp, Artificial Sequence
  ICAM-1 target sequence
aaggtgacgctgaatggggtt

SEQ ID NO: 1280 - DNA, 21 bp, Artificial Sequence
  ICAM-1 target sequence
aatggggttccagcccagcca

SEQ ID NO: 1281 - DNA, 21 bp, Artificial Sequence
  ICAM-1 target sequence
aaggccaccccagaggacaac

SEQ ID NO: 1282 - DNA, 21 bp, Artificial Sequence
  ICAM-1 target sequence
aacgggcgcagcttctcctgc

SEQ ID NO: 1283 - DNA, 21 bp, Artificial Sequence
  ICAM-1 target sequence
aaccctggaggtggccggcca

SEQ ID NO: 1284 - DNA, 21 bp, Artificial Sequence
  ICAM-1 target sequence
aagaaccagacccgggagctt

SEQ ID NO: 1285 - DNA, 21 bp, Artificial Sequence
  ICAM-1 target sequence
aaccagacccgggagcttcgt

SEQ ID NO: 1286 - DNA, 21 bp, Artificial Sequence
  ICAM-1 target sequence
aaactggacgtggccagaaaa

SEQ ID NO: 1287 - DNA, 21 bp, Artificial Sequence
  ICAM-1 target sequence
aactggacgtggccagaaaat

SEQ ID NO: 1288 - DNA, 21 bp, Artificial Sequence
  ICAM-1 target sequence
aaaattcccagcagactccaa

SEQ ID NO: 1289 - DNA, 21 bp, Artificial Sequence
  ICAM-1 target sequence
aaattcccagcagactccaat

SEQ ID NO: 1290 - DNA, 21 bp, Artificial Sequence
  ICAM-1 target sequence
aattcccagcagactccaatg

SEQ ID NO: 1291 - DNA, 21 bp, Artificial Sequence
  ICAM-1 target sequence
aatgtgccaggcttgggggaa

SEQ ID NO: 1292 - DNA, 21 bp, Artificial Sequence
  ICAM-1 target sequence
aacccattgcccgagctcaag

SEQ ID NO: 1293 - DNA, 21 bp, Artificial Sequence
  ICAM-1 target sequence
aagtgtctaaaggatggcact

SEQ ID NO: 1294 - DNA, 21 bp, Artificial Sequence
  ICAM-1 target sequence
aaaggatggcactttcccact

SEQ ID NO: 1295 - DNA, 21 bp, Artificial Sequence
  ICAM-1 target sequence
aaggatggcactttcccactg

SEQ ID NO: 1296 - DNA, 21 bp, Artificial Sequence
  ICAM-1 target sequence
aatcagtgactgtcactcgag

SEQ ID NO: 1297 - DNA, 21 bp, Artificial Sequence
  ICAM-1 target sequence
aaggggaggtcacccgcgagg

SEQ ID NO: 1298 - DNA, 21 bp, Artificial Sequence
  ICAM-1 target sequence
aatgtgctctccccccggtat

SEQ ID NO: 1299 - DNA, 21 bp, Artificial Sequence
  ICAM-1 target sequence
aatgggcactgcaggcctcag

SEQ ID NO: 1300 - DNA, 21 bp, Artificial Sequence
  ICAM-1 target sequence
aaccgccagcggaagatcaag

SEQ ID NO: 1301 - DNA, 21 bp, Artificial Sequence
  ICAM-1 target sequence
aagatcaagaaatacagacta

SEQ ID NO: 1302 - DNA, 21 bp, Artificial Sequence
  ICAM-1 target sequence
aagaaatacagactacaacag

SEQ ID NO: 1303 - DNA, 21 bp, Artificial Sequence
  ICAM-1 target sequence
aaatacagactacaacaggcc

SEQ ID NO: 1304 - DNA, 21 bp, Artificial Sequence
  ICAM-1 target sequence
aatacagactacaacaggccc

SEQ ID NO: 1305 - DNA, 21 bp, Artificial Sequence
  ICAM-1 target sequence
aacaggcccaaaaagggaccc

SEQ ID NO: 1306 - DNA, 21 bp, Artificial Sequence
  ICAM-1 target sequence
aaaaagggacccccatgaaac

SEQ ID NO: 1307 - DNA, 21 bp, Artificial Sequence
  ICAM-1 target sequence
aaaagggacccccatgaaacc

SEQ ID NO: 1308 - DNA, 21 bp, Artificial Sequence
  Ang1 target sequence
aatcagcgccgaagtccagaa

SEQ ID NO: 1309 - DNA, 21 bp, Artificial Sequence
  Ang1 target sequence
aagtccagaaaacagtgggag

SEQ ID NO: 1310 - DNA, 21 bp, Artificial Sequence
  Ang1 target sequence
aaaacagtgggagaagatata

SEQ ID NO: 1311 - DNA, 21 bp, Artificial Sequence
  Ang1 target sequence
aaacagtgggagaagatataa

SEQ ID NO: 1312 - DNA, 21 bp, Artificial Sequence
  Ang1 target sequence
aacagtgggagaagatataac

SEQ ID NO: 1313 - DNA, 21 bp, Artificial Sequence
  Ang1 target sequence
aagatataaccggattcaaca

SEQ ID NO: 1314 - DNA, 21 bp, Artificial Sequence
  Ang1 target sequence
aaccggattcaacatgggcaa

SEQ ID NO: 1315 - DNA, 21 bp, Artificial Sequence
  Ang1 target sequence
aacatgggcaatgtgcctaca

SEQ ID NO: 1316 - DNA, 21 bp, Artificial Sequence
  Ang1 target sequence
aatgtgcctacactttcattc

SEQ ID NO: 1317 - DNA, 21 bp, Artificial Sequence
  Ang1 target sequence
aacacgatggcaactgtcgtg

SEQ ID NO: 1318 - DNA, 21 bp, Artificial Sequence
  Ang1 target sequence
aactgtcgtgagagtacgaca

SEQ ID NO: 1319 - DNA, 21 bp, Artificial Sequence
  Ang1 target sequence
aacacaaacgctctgcagaga

SEQ ID NO: 1320 - DNA, 21 bp, Artificial Sequence
  Ang1 target sequence
aaacgctctgcagagagatgc

SEQ ID NO: 1321 - DNA, 21 bp, Artificial Sequence
  Ang1 target sequence
aacgctctgcagagagatgct

SEQ ID NO: 1322 - DNA, 21 bp, Artificial Sequence
  Ang1 target sequence
aaccggatttctcttcccaga

SEQ ID NO: 1323 - DNA, 21 bp, Artificial Sequence
  Ang1 target sequence
aaacttcaacatctggaacat

SEQ ID NO: 1324 - DNA, 21 bp, Artificial Sequence
  Ang1 target sequence
aacttcaacatctggaacatg

SEQ ID NO: 1325 - DNA, 21 bp, Artificial Sequence
  Ang1 target sequence
aacatctggaacatgtgatgg

SEQ ID NO: 1326 - DNA, 21 bp, Artificial Sequence
  Ang1 target sequence
aacatgtgatggaaaattata

SEQ ID NO: 1327 - DNA, 21 bp, Artificial Sequence
  Ang1 target sequence
aaaattatactcagtggctgc

SEQ ID NO: 1328 - DNA, 21 bp, Artificial Sequence
  Ang1 target sequence
aaattatactcagtggctgca

SEQ ID NO: 1329 - DNA, 21 bp, Artificial Sequence
  Ang1 target sequence
aattatactcagtggctgcaa

SEQ ID NO: 1330 - DNA, 21 bp, Artificial Sequence
  Ang1 target sequence
aaaaacttgagaattacattg

SEQ ID NO: 1331 - DNA, 21 bp, Artificial Sequence
  Ang1 target sequence
aaaacttgagaattacattgt

SEQ ID NO: 1332 - DNA, 21 bp, Artificial Sequence
  Ang1 target sequence
aaacttgagaattacattgtg

SEQ ID NO: 1333 - DNA, 21 bp, Artificial Sequence
  Ang1 target sequence
aacttgagaattacattgtgg

SEQ ID NO: 1334 - DNA, 21 bp, Artificial Sequence
  Ang1 target sequence
aattacattgtggaaaacatg

SEQ ID NO: 1335 - DNA, 21 bp, Artificial Sequence
  Ang1 target sequence
aaaacatgaagtcggagatgg

SEQ ID NO: 1336 - DNA, 21 bp, Artificial Sequence
  Ang1 target sequence
aaacatgaagtcggagatggc

SEQ ID NO: 1337 - DNA, 21 bp, Artificial Sequence
  Ang1 target sequence
aacatgaagtcggagatggcc

SEQ ID NO: 1338 - DNA, 21 bp, Artificial Sequence
  Ang1 target sequence
aagtcggagatggcccagata

SEQ ID NO: 1339 - DNA, 21 bp, Artificial Sequence
  Ang1 target sequence
aatgcagttcagaaccacacg

SEQ ID NO: 1340 - DNA, 21 bp, Artificial Sequence
  Ang1 target sequence
aaccacacggctaccatgctg

SEQ ID NO: 1341 - DNA, 21 bp, Artificial Sequence
  Ang1 target sequence
aaccagcctcctctctcagac

SEQ ID NO: 1342 - DNA, 21 bp, Artificial Sequence
  Ang1 target sequence
aaagctgacagatgttgagac

SEQ ID NO: 1343 - DNA, 21 bp, Artificial Sequence
  Ang1 target sequence
aagctgacagatgttgagacc

SEQ ID NO: 1344 - DNA, 21 bp, Artificial Sequence
  Ang1 target sequence
aaatcaaacttctcgacttga

SEQ ID NO: 1345 - DNA, 21 bp, Artificial Sequence
  Ang1 target sequence
aatcaaacttctcgacttgag

SEQ ID NO: 1346 - DNA, 21 bp, Artificial Sequence
  Ang1 target sequence
aaacttctcgacttgagatac

SEQ ID NO: 1347 - DNA, 21 bp, Artificial Sequence
  Ang1 target sequence
aacttctcgacttgagataca

SEQ ID NO: 1348 - DNA, 21 bp, Artificial Sequence
  Ang1 target sequence
aattcattatccacctacaag

SEQ ID NO: 1349 - DNA, 21 bp, Artificial Sequence
  Ang1 target sequence
aagctagagaagcaacttctt

SEQ ID NO: 1350 - DNA, 21 bp, Artificial Sequence
  Ang1 target sequence
aagcaacttcttcaacagaca

SEQ ID NO: 1351 - DNA, 21 bp, Artificial Sequence
  Ang1 target sequence
aacttcttcaacagacaaatg

SEQ ID NO: 1352 - DNA, 21 bp, Artificial Sequence
  Ang1 target sequence
aacagacaaatgaaatcttga

SEQ ID NO: 1353 - DNA, 21 bp, Artificial Sequence
  Ang1 target sequence
aaatgaaatcttgaagatcca

SEQ ID NO: 1354 - DNA, 21 bp, Artificial Sequence
  Ang1 target sequence
aatgaaatcttgaagatccat

SEQ ID NO: 1355 - DNA, 20 bp, Artificial Sequence
  Ang1 target sequence
aaatcttgaagatccatgaa

SEQ ID NO: 1356 - DNA, 21 bp, Artificial Sequence
  Ang1 target sequence
aatcttgaagatccatgaaaa

SEQ ID NO: 1357 - DNA, 21 bp, Artificial Sequence
  Ang1 target sequence
aagatccatgaaaaaaacagt

SEQ ID NO: 1358 - DNA, 21 bp, Artificial Sequence
  Ang1 target sequence
aaaaaaacagtttattagaac

SEQ ID NO: 1359 - DNA, 21 bp, Artificial Sequence
  Ang1 target sequence
aaaaaacagtttattagaaca

SEQ ID NO: 1360 - DNA, 21 bp, Artificial Sequence
  Ang1 target sequence
aaaaacagtttattagaacat

SEQ ID NO: 1361 - DNA, 21 bp, Artificial Sequence
  Ang1 target sequence
aaaacagtttattagaacata

SEQ ID NO: 1362 - DNA, 21 bp, Artificial Sequence
  Ang1 target sequence
aaacagtttattagaacataa

SEQ ID NO: 1363 - DNA, 21 bp, Artificial Sequence
  Ang1 target sequence
aacagtttattagaacataaa

SEQ ID NO: 1364 - DNA, 21 bp, Artificial Sequence
  Ang1 target sequence
aacataaaatcttagaaatgg

SEQ ID NO: 1365 - DNA, 21 bp, Artificial Sequence
  Ang1 target sequence
aaaatcttagaaatggaagga

SEQ ID NO: 1366 - DNA, 21 bp, Artificial Sequence
  Ang1 target sequence
aaatcttagaaatggaaggaa

SEQ ID NO: 1367 - DNA, 21 bp, Artificial Sequence
  Ang1 target sequence
aatcttagaaatggaaggaaa

SEQ ID NO: 1368 - DNA, 21 bp, Artificial Sequence
  Ang1 target sequence
aaatggaaggaaaacacaagg

SEQ ID NO: 1369 - DNA, 21 bp, Artificial Sequence
  Ang1 target sequence
aatggaaggaaaacacaagga

SEQ ID NO: 1370 - DNA, 21 bp, Artificial Sequence
  Ang1 target sequence
aaggaaaacacaaggaagagt

SEQ ID NO: 1371 - DNA, 21 bp, Artificial Sequence
  Ang1 target sequence
aaaacacaaggaagagttgga

SEQ ID NO: 1372 - DNA, 21 bp, Artificial Sequence
  Ang1 target sequence
aaacacaaggaagagttggac

SEQ ID NO: 1373 - DNA, 21 bp, Artificial Sequence
  Ang1 target sequence
aacacaaggaagagttggaca

SEQ ID NO: 1374 - DNA, 21 bp, Artificial Sequence
  Ang1 target sequence
aaggaagagttggacacctta

SEQ ID NO: 1375 - DNA, 21 bp, Artificial Sequence
  Ang1 target sequence
aagagttggacaccttaaagg

SEQ ID NO: 1376 - DNA, 21 bp, Artificial Sequence
  Ang1 target sequence
aaaggaagagaaagagaacct

SEQ ID NO: 1377 - DNA, 21 bp, Artificial Sequence
  Ang1 target sequence
aaggaagagaaagagaacctt

SEQ ID NO: 1378 - DNA, 21 bp, Artificial Sequence
  Ang1 target sequence
aagagaaagagaaccttcaag

SEQ ID NO: 1379 - DNA, 21 bp, Artificial Sequence
  Ang1 target sequence
aaagagaaccttcaaggcttg

SEQ ID NO: 1380 - DNA, 21 bp, Artificial Sequence
  Ang1 target sequence
aagagaaccttcaaggcttgg

SEQ ID NO: 1381 - DNA, 21 bp, Artificial Sequence
  Ang1 target sequence
aaccttcaaggcttggttact

SEQ ID NO: 1382 - DNA, 21 bp, Artificial Sequence
  Ang1 target sequence
aaggcttggttactcgtcaaa

SEQ ID NO: 1383 - DNA, 21 bp, Artificial Sequence
  Ang1 target sequence
aaacatatataatccaggagc

SEQ ID NO: 1384 - DNA, 21 bp, Artificial Sequence
  Ang1 target sequence
aacatatataatccaggagct

SEQ ID NO: 1385 - DNA, 21 bp, Artificial Sequence
  Ang1 target sequence
aatccaggagctggaaaagca

SEQ ID NO: 1386 - DNA, 21 bp, Artificial Sequence
  Ang1 target sequence
aaaagcaattaaacagagcta

SEQ ID NO: 1387 - DNA, 21 bp, Artificial Sequence
  Ang1 target sequence
aaagcaattaaacagagctac

SEQ ID NO: 1388 - DNA, 21 bp, Artificial Sequence
  Ang1 target sequence
aagcaattaaacagagctacc

SEQ ID NO: 1389 - DNA, 21 bp, Artificial Sequence
  Ang1 target sequence
aattaaacagagctaccacca

SEQ ID NO: 1390 - DNA, 21 bp, Artificial Sequence
  Ang1 target sequence
aaacagagctaccaccaacaa

SEQ ID NO: 1391 - DNA, 21 bp, Artificial Sequence
  Ang1 target sequence
aacagagctaccaccaacaac

SEQ ID NO: 1392 - DNA, 21 bp, Artificial Sequence
  Ang1 target sequence
aacaacagtgtccttcagaag

SEQ ID NO: 1393 - DNA, 21 bp, Artificial Sequence
  Ang1 target sequence
aacagtgtccttcagaagcag

SEQ ID NO: 1394 - DNA, 21 bp, Artificial Sequence
  Ang1 target sequence
aagcagcaactggagctgatg

SEQ ID NO: 1395 - DNA, 21 bp, Artificial Sequence
  Ang1 target sequence
aactggagctgatggacacag

SEQ ID NO: 1396 - DNA, 21 bp, Artificial Sequence
  Ang1 target sequence
aaccttgtcaatctttgcact

SEQ ID NO: 1397 - DNA, 21 bp, Artificial Sequence
  Ang1 target sequence
aatctttgcactaaagaaggt

SEQ ID NO: 1398 - DNA, 21 bp, Artificial Sequence
  Ang1 target sequence
aaagaaggtgttttactaaag

SEQ ID NO: 1399 - DNA, 21 bp, Artificial Sequence
  Ang1 target sequence
aagaaggtgttttactaaagg

SEQ ID NO: 1400 - DNA, 21 bp, Artificial Sequence
  Ang1 target sequence
aaggtgttttactaaagggag

SEQ ID NO: 1401 - DNA, 21 bp, Artificial Sequence
  Ang1 target sequence
aaagggaggaaaaagagagga

SEQ ID NO: 1402 - DNA, 21 bp, Artificial Sequence
  Ang1 target sequence
aagggaggaaaaagagaggaa

SEQ ID NO: 1403 - DNA, 21 bp, Artificial Sequence
  Ang1 target sequence
aaaaagagaggaagagaaacc

SEQ ID NO: 1404 - DNA, 21 bp, Artificial Sequence
  Ang1 target sequence
aaaagagaggaagagaaacca

SEQ ID NO: 1405 - DNA, 21 bp, Artificial Sequence
  Ang1 target sequence
aaagagaggaagagaaaccat

SEQ ID NO: 1406 - DNA, 21 bp, Artificial Sequence
  Ang1 target sequence
aagagaggaagagaaaccatt

SEQ ID NO: 1407 - DNA, 21 bp, Artificial Sequence
  Ang1 target sequence
aagagaaaccatttagagact

SEQ ID NO: 1408 - DNA, 21 bp, Artificial Sequence
  Ang1 target sequence
aaaccatttagagactgtgca

SEQ ID NO: 1409 - DNA, 21 bp, Artificial Sequence
  Ang1 target sequence
aaccatttagagactgtgcag

SEQ ID NO: 1410 - DNA, 21 bp, Artificial Sequence
  Ang1 target sequence
aagctggttttaataaaagtg

SEQ ID NO: 1411 - DNA, 21 bp, Artificial Sequence
  Ang1 target sequence
aataaaagtggaatctacact

SEQ ID NO: 1412 - DNA, 21 bp, Artificial Sequence
  Ang1 target sequence
aaaagtggaatctacactatt

SEQ ID NO: 1413 - DNA, 21 bp, Artificial Sequence
  Ang1 target sequence
aaagtggaatctacactattt

SEQ ID NO: 1414 - DNA, 21 bp, Artificial Sequence
  Ang1 target sequence
aagtggaatctacactattta

SEQ ID NO: 1415 - DNA, 21 bp, Artificial Sequence
  Ang1 target sequence
aatctacactatttatattaa

SEQ ID NO: 1416 - DNA, 21 bp, Artificial Sequence
  Ang1 target sequence
aataatatgccagaacccaaa

SEQ ID NO: 1417 - DNA, 21 bp, Artificial Sequence
  Ang1 target sequence
aatatgccagaacccaaaaag

SEQ ID NO: 1418 - DNA, 21 bp, Artificial Sequence
  Ang1 target sequence
aacccaaaaaggtgttttgca

SEQ ID NO: 1419 - DNA, 21 bp, Artificial Sequence
  Ang1 target sequence
aaaaaggtgttttgcaatatg

SEQ ID NO: 1420 - DNA, 21 bp, Artificial Sequence
  Ang1 target sequence
aaaaggtgttttgcaatatgg

SEQ ID NO: 1421 - DNA, 21 bp, Artificial Sequence
  Ang1 target sequence
aaaggtgttttgcaatatgga

SEQ ID NO: 1422 - DNA, 21 bp, Artificial Sequence
  Ang1 target sequence
aaggtgttttgcaatatggat

SEQ ID NO: 1423 - DNA, 21 bp, Artificial Sequence
  Ang1 target sequence
aatatggatgtcaatggggga

SEQ ID NO: 1424 - DNA, 21 bp, Artificial Sequence
  Ang1 target sequence
aatgggggaggttggactgta

SEQ ID NO: 1425 - DNA, 21 bp, Artificial Sequence
  Ang1 target sequence
aatacaacatcgtgaagatgg

SEQ ID NO: 1426 - DNA, 21 bp, Artificial Sequence
  Ang1 target sequence
aacatcgtgaagatggaagtc

SEQ ID NO: 1427 - DNA, 21 bp, Artificial Sequence
  Ang1 target sequence
aagatggaagtctagatttcc

SEQ ID NO: 1428 - DNA, 21 bp, Artificial Sequence
  Ang1 target sequence
aagtctagatttccaaagagg

SEQ ID NO: 1429 - DNA, 21 bp, Artificial Sequence
  Ang1 target sequence
aaagaggctggaaggaatata

SEQ ID NO: 1430 - DNA, 21 bp, Artificial Sequence
  Ang1 target sequence
aagaggctggaaggaatataa

SEQ ID NO: 1431 - DNA, 21 bp, Artificial Sequence
  Ang1 target sequence
aaggaatataaaatgggtttt

SEQ ID NO: 1432 - DNA, 21 bp, Artificial Sequence
  Ang1 target sequence
aatataaaatgggttttggaa

SEQ ID NO: 1433 - DNA, 20 bp, Artificial Sequence
  Ang1 target sequence
aaaatgggttttggaaatcc

SEQ ID NO: 1434 - DNA, 21 bp, Artificial Sequence
  Ang1 target sequence
aaatgggttttggaaatccct

SEQ ID NO: 1435 - DNA, 21 bp, Artificial Sequence
  Ang1 target sequence
aatgggttttggaaatccctc

SEQ ID NO: 1436 - DNA, 21 bp, Artificial Sequence
  Ang1 target sequence
aaatccctccggtgaatattg

SEQ ID NO: 1437 - DNA, 21 bp, Artificial Sequence
  Ang1 target sequence
aatccctccggtgaatattgg

SEQ ID NO: 1438 - DNA, 21 bp, Artificial Sequence
  Ang1 target sequence
aatattggctggggaatgagt

SEQ ID NO: 1439 - DNA, 21 bp, Artificial Sequence
  Ang1 target sequence
aatgagtttatttttgccatt

SEQ ID NO: 1440 - DNA, 21 bp, Artificial Sequence
  Ang1 target sequence
aagaattgagttaatggactg

SEQ ID NO: 1441 - DNA, 21 bp, Artificial Sequence
  Ang1 target sequence
aattgagttaatggactggga

SEQ ID NO: 1442 - DNA, 21 bp, Artificial Sequence
  Ang1 target sequence
aatggactgggaagggaaccg

SEQ ID NO: 1443 - DNA, 21 bp, Artificial Sequence
  Ang1 target sequence
aagggaaccgagcctattcac

SEQ ID NO: 1444 - DNA, 21 bp, Artificial Sequence
  Ang1 target sequence
aaccgagcctattcacagtat

SEQ ID NO: 1445 - DNA, 21 bp, Artificial Sequence
  Ang1 target sequence
aaatgaaaagcaaaactatag

SEQ ID NO: 1446 - DNA, 21 bp, Artificial Sequence
  Ang1 target sequence
aatgaaaagcaaaactatagg

SEQ ID NO: 1447 - DNA, 21 bp, Artificial Sequence
  Ang1 target sequence
aaaagcaaaactataggttgt

SEQ ID NO: 1448 - DNA, 21 bp, Artificial Sequence
  Ang1 target sequence
aaagcaaaactataggttgta

SEQ ID NO: 1449 - DNA, 21 bp, Artificial Sequence
  Ang1 target sequence
aagcaaaactataggttgtat

SEQ ID NO: 1450 - DNA, 21 bp, Artificial Sequence
  Ang1 target sequence
aaaactataggttgtatttaa

SEQ ID NO: 1451 - DNA, 21 bp, Artificial Sequence
  Ang1 target sequence
aaactataggttgtatttaaa

SEQ ID NO: 1452 - DNA, 21 bp, Artificial Sequence
  Ang1 target sequence
aactataggttgtatttaaaa

SEQ ID NO: 1453 - DNA, 21 bp, Artificial Sequence
  Ang1 target sequence
aaaaggtcacactgggacagc

SEQ ID NO: 1454 - DNA, 21 bp, Artificial Sequence
  Ang1 target sequence
aaaggtcacactgggacagca

SEQ ID NO: 1455 - DNA, 21 bp, Artificial Sequence
  Ang1 target sequence
aaggtcacactgggacagcag

SEQ ID NO: 1456 - DNA, 21 bp, Artificial Sequence
  Ang1 target sequence
aaaacagagcagcctgatctt

SEQ ID NO: 1457 - DNA, 21 bp, Artificial Sequence
  Ang1 target sequence
aaacagagcagcctgatctta

SEQ ID NO: 1458 - DNA, 21 bp, Artificial Sequence
  Ang1 target sequence
aacagagcagcctgatcttac

SEQ ID NO: 1459 - DNA, 21 bp, Artificial Sequence
  Ang1 target sequence
aaagatgctgataatgacaac

SEQ ID NO: 1460 - DNA, 21 bp, Artificial Sequence
  Ang1 target sequence
aagatgctgataatgacaact

SEQ ID NO: 1461 - DNA, 21 bp, Artificial Sequence
  Ang1 target sequence
aatgacaactgtatgtgcaaa

SEQ ID NO: 1462 - DNA, 21 bp, Artificial Sequence
  Ang1 target sequence
aactgtatgtgcaaatgtgcc

SEQ ID NO: 1463 - DNA, 21 bp, Artificial Sequence
  Ang1 target sequence
aaatgtgccctcatgttaaca

SEQ ID NO: 1464 - DNA, 21 bp, Artificial Sequence
  Ang1 target sequence
aatgtgccctcatgttaacag

SEQ ID NO: 1465 - DNA, 21 bp, Artificial Sequence
  Ang1 target sequence
aacaggaggatggtggtttga

SEQ ID NO: 1466 - DNA, 21 bp, Artificial Sequence
  Ang1 target sequence
aatctaaatggaatgttctat

SEQ ID NO: 1467 - DNA, 21 bp, Artificial Sequence
  Ang1 target sequence
aaatggaatgttctatactgc

SEQ ID NO: 1468 - DNA, 21 bp, Artificial Sequence
  Ang1 target sequence
aatggaatgttctatactgcg

SEQ ID NO: 1469 - DNA, 21 bp, Artificial Sequence
  Ang1 target sequence
aatgttctatactgcgggaca

SEQ ID NO: 1470 - DNA, 21 bp, Artificial Sequence
  Ang1 target sequence
aaaaccatggaaaactgaatg

SEQ ID NO: 1471 - DNA, 21 bp, Artificial Sequence
  Ang1 target sequence
aaaccatggaaaactgaatgg

SEQ ID NO: 1472 - DNA, 21 bp, Artificial Sequence
  Ang1 target sequence
aaccatggaaaactgaatggg

SEQ ID NO: 1473 - DNA, 21 bp, Artificial Sequence
  Ang1 target sequence
aaaactgaatgggataaagtg

SEQ ID NO: 1474 - DNA, 21 bp, Artificial Sequence
  Ang1 target sequence
aaactgaatgggataaagtgg

SEQ ID NO: 1475 - DNA, 21 bp, Artificial Sequence
  Ang1 target sequence
aactgaatgggataaagtggc

SEQ ID NO: 1476 - DNA, 21 bp, Artificial Sequence
  Ang1 target sequence
aatgggataaagtggcactac

SEQ ID NO: 1477 - DNA, 21 bp, Artificial Sequence
  Ang1 target sequence
aaagtggcactacttcaaagg

SEQ ID NO: 1478 - DNA, 21 bp, Artificial Sequence
  Ang1 target sequence
aagtggcactacttcaaaggg

SEQ ID NO: 1479 - DNA, 21 bp, Artificial Sequence
  Ang1 target sequence
aaagggcccagttactcctta

SEQ ID NO: 1480 - DNA, 21 bp, Artificial Sequence
  Ang1 target sequence
aagggcccagttactccttac

SEQ ID NO: 1481 - DNA, 21 bp, Artificial Sequence
  Ang1 target sequence
gaagtccagaaaacagtggga

SEQ ID NO: 1482 - DNA, 21 bp, Artificial Sequence
  Ang1 target sequence
atggcaactgtcgtgagagta

SEQ ID NO: 1483 - DNA, 21 bp, Artificial Sequence
  Ang1 target sequence
cgtggaaccggatttctcttc

SEQ ID NO: 1484 - DNA, 21 bp, Artificial Sequence
  Ang1 target sequence
cattgtggaaaacatgaagtc

SEQ ID NO: 1485 - DNA, 21 bp, Artificial Sequence
  Ang1 target sequence
ttcagaaccacacggctacca

SEQ ID NO: 1486 - DNA, 21 bp, Artificial Sequence
  Ang1 target sequence
tactaaatcaaacttctcgac

SEQ ID NO: 1487 - DNA, 21 bp, Artificial Sequence
  Ang1 target sequence
cttcaacagacaaatgaaatc

SEQ ID NO: 1488 - DNA, 21 bp, Artificial Sequence
  Ang1 target sequence
gttggacaccttaaaggaaga

SEQ ID NO: 1489 - DNA, 21 bp, Artificial Sequence
  Ang1 target sequence
agctaccaccaacaacagtgt

SEQ ID NO: 1490 - DNA, 21 bp, Artificial Sequence
  Ang1 target sequence
ggtgttttactaaagggagga

SEQ ID NO: 1491 - DNA, 21 bp, Artificial Sequence
  Ang1 target sequence
tgtatatcaagctggttttaa

SEQ ID NO: 1492 - DNA, 21 bp, Artificial Sequence
  Ang1 target sequence
ccaaaaaggtgttttgcaata

SEQ ID NO: 1493 - DNA, 21 bp, Artificial Sequence
  Ang1 target sequence
gctggaaggaatataaaatgg

SEQ ID NO: 1494 - DNA, 21 bp, Artificial Sequence
  Ang1 target sequence
tcagaggcagtacatgctaag

SEQ ID NO: 1495 - DNA, 21 bp, Artificial Sequence
  Ang1 target sequence
acactgggacagcaggaaaac

SEQ ID NO: 1496 - DNA, 20 bp, Artificial Sequence
  Ang1 target sequence
atttcagcactaaagatgct

SEQ ID NO: 1497 - DNA, 22 bp, Artificial Sequence
  Ang1 target sequence
gataatgacaactgtatgtgca

SEQ ID NO: 1498 - DNA, 19 bp, Artificial Sequence
  Ang1 target sequence
tgtgccctcatgttaacag

SEQ ID NO: 1499 - DNA, 18 bp, Artificial Sequence
  Ang1 target sequence
aggatggtggtttgatgc

SEQ ID NO: 1500 - DNA, 19 bp, Artificial Sequence
  Ang1 target sequence
tggcccctccaatctaaat

SEQ ID NO: 1501 - DNA, 22 bp, Artificial Sequence
  Ang1 target sequence
aatgttctatactgcgggacaa

SEQ ID NO: 1502 - DNA, 23 bp, Artificial Sequence
  Ang1 target sequence
atggaaaactgaatgggataaag

SEQ ID NO: 1503 - DNA, 24 bp, Artificial Sequence
  Ang1 target sequence
aactgaatgggataaagtggcact

SEQ ID NO: 1504 - DNA, 21 bp, Artificial Sequence
  Ang2 target sequence
aacaactttcggaagagcatg

SEQ ID NO: 1505 - DNA, 21 bp, Artificial Sequence
  Ang2 target sequence
aactttcggaagagcatggac

SEQ ID NO: 1506 - DNA, 21 bp, Artificial Sequence
  Ang2 target sequence
aagagcatggacagcatagga

SEQ ID NO: 1507 - DNA, 21 bp, Artificial Sequence
  Ang2 target sequence
aaagaagcaatatcaggtcca

SEQ ID NO: 1508 - DNA, 21 bp, Artificial Sequence
  Ang2 target sequence
aagaagcaatatcaggtccag

SEQ ID NO: 1509 - DNA, 21 bp, Artificial Sequence
  Ang2 target sequence
aagcaatatcaggtccagcat

SEQ ID NO: 1510 - DNA, 21 bp, Artificial Sequence
  Ang2 target sequence
aatatcaggtccagcatgggt

SEQ ID NO: 1511 - DNA, 21 bp, Artificial Sequence
  Ang2 target sequence
aactgccgctcttcctccagc

SEQ ID NO: 1512 - DNA, 21 bp, Artificial Sequence
  Ang2 target sequence
aatgctgtgcagagggacgcg

SEQ ID NO: 1513 - DNA, 21 bp, Artificial Sequence
  Ang2 target sequence
aatacgatgactcggtgcaga

SEQ ID NO: 1514 - DNA, 21 bp, Artificial Sequence
  Ang2 target sequence
aagtgctggagaacatcatgg

SEQ ID NO: 1515 - DNA, 21 bp, Artificial Sequence
  Ang2 target sequence
aacatcatggaaaacaacact

SEQ ID NO: 1516 - DNA, 21 bp, Artificial Sequence
  Ang2 target sequence
aaaacaacactcagtggctaa

SEQ ID NO: 1517 - DNA, 21 bp, Artificial Sequence
  Ang2 target sequence
aaacaacactcagtggctaat

SEQ ID NO: 1518 - DNA, 21 bp, Artificial Sequence
  Ang2 target sequence
aacaacactcagtggctaatg

SEQ ID NO: 1519 - DNA, 21 bp, Artificial Sequence
  Ang2 target sequence
aacactcagtggctaatgaag

SEQ ID NO: 1520 - DNA, 21 bp, Artificial Sequence
  Ang2 target sequence
aatgaagcttgagaattatat

SEQ ID NO: 1521 - DNA, 21 bp, Artificial Sequence
  Ang2 target sequence
aagcttgagaattatatccag

SEQ ID NO: 1522 - DNA, 21 bp, Artificial Sequence
  Ang2 target sequence
aattatatccaggacaacatg

SEQ ID NO: 1523 - DNA, 21 bp, Artificial Sequence
  Ang2 target sequence
aacatgaagaaagaaatggta

SEQ ID NO: 1524 - DNA, 21 bp, Artificial Sequence
  Ang2 target sequence
aagaaagaaatggtagagata

SEQ ID NO: 1525 - DNA, 21 bp, Artificial Sequence
  Ang2 target sequence
aaagaaatggtagagatacag

SEQ ID NO: 1526 - DNA, 21 bp, Artificial Sequence
  Ang2 target sequence
aagaaatggtagagatacagc

SEQ ID NO: 1527 - DNA, 21 bp, Artificial Sequence
  Ang2 target sequence
aaatggtagagatacagcaga

SEQ ID NO: 1528 - DNA, 21 bp, Artificial Sequence
  Ang2 target sequence
aatggtagagatacagcagaa

SEQ ID NO: 1529 - DNA, 21 bp, Artificial Sequence
  Ang2 target sequence
aatgcagtacagaaccagacg

SEQ ID NO: 1530 - DNA, 21 bp, Artificial Sequence
  Ang2 target sequence
aaccagacggctgtgatgata

SEQ ID NO: 1531 - DNA, 21 bp, Artificial Sequence
  Ang2 target sequence
aaatagggacaaacctgttga

SEQ ID NO: 1532 - DNA, 21 bp, Artificial Sequence
  Ang2 target sequence
aatagggacaaacctgttgaa

SEQ ID NO: 1533 - DNA, 21 bp, Artificial Sequence
  Ang2 target sequence
aaacctgttgaaccaaacagc

SEQ ID NO: 1534 - DNA, 21 bp, Artificial Sequence
  Ang2 target sequence
aacctgttgaaccaaacagct

SEQ ID NO: 1535 - DNA, 21 bp, Artificial Sequence
  Ang2 target sequence
aaccaaacagctgagcaaacg

SEQ ID NO: 1536 - DNA, 21 bp, Artificial Sequence
  Ang2 target sequence
aaacagctgagcaaacgcgga

SEQ ID NO: 1537 - DNA, 21 bp, Artificial Sequence
  Ang2 target sequence
aacagctgagcaaacgcggaa

SEQ ID NO: 1538 - DNA, 21 bp, Artificial Sequence
  Ang2 target sequence
aaacgcggaagttaactgatg

SEQ ID NO: 1539 - DNA, 21 bp, Artificial Sequence
  Ang2 target sequence
aacgcggaagttaactgatgt

SEQ ID NO: 1540 - DNA, 21 bp, Artificial Sequence
  Ang2 target sequence
aagttaactgatgtggaagcc

SEQ ID NO: 1541 - DNA, 21 bp, Artificial Sequence
  Ang2 target sequence
aactgatgtggaagcccaagt

SEQ ID NO: 1542 - DNA, 21 bp, Artificial Sequence
  Ang2 target sequence
aagcccaagtattaaatcaga

SEQ ID NO: 1543 - DNA, 21 bp, Artificial Sequence
  Ang2 target sequence
aagtattaaatcagaccacga

SEQ ID NO: 1544 - DNA, 21 bp, Artificial Sequence
  Ang2 target sequence
aaatcagaccacgagacttga

SEQ ID NO: 1545 - DNA, 21 bp, Artificial Sequence
  Ang2 target sequence
aatcagaccacgagacttgaa

SEQ ID NO: 1546 - DNA, 21 bp, Artificial Sequence
  Ang2 target sequence
aacttcagctcttggaacact

SEQ ID NO: 1547 - DNA, 21 bp, Artificial Sequence
  Ang2 target sequence
aacactccctctcgacaaaca

SEQ ID NO: 1548 - DNA, 21 bp, Artificial Sequence
  Ang2 target sequence
aaacaaattggaaaaacagat

SEQ ID NO: 1549 - DNA, 21 bp, Artificial Sequence
  Ang2 target sequence
aacaaattggaaaaacagatt

SEQ ID NO: 1550 - DNA, 21 bp, Artificial Sequence
  Ang2 target sequence
aaattggaaaaacagattttg

SEQ ID NO: 1551 - DNA, 21 bp, Artificial Sequence
  Ang2 target sequence
aattggaaaaacagattttgg

SEQ ID NO: 1552 - DNA, 21 bp, Artificial Sequence
  Ang2 target sequence
aaaaacagattttggaccaga

SEQ ID NO: 1553 - DNA, 21 bp, Artificial Sequence
  Ang2 target sequence
aaaacagattttggaccagac

SEQ ID NO: 1554 - DNA, 21 bp, Artificial Sequence
  Ang2 target sequence
aaacagattttggaccagacc

SEQ ID NO: 1555 - DNA, 21 bp, Artificial Sequence
  Ang2 target sequence
aacagattttggaccagacca

SEQ ID NO: 1556 - DNA, 21 bp, Artificial Sequence
  Ang2 target sequence
aaataaacaaattgcaagata

SEQ ID NO: 1557 - DNA, 21 bp, Artificial Sequence
  Ang2 target sequence
aataaacaaattgcaagataa

SEQ ID NO: 1558 - DNA, 21 bp, Artificial Sequence
  Ang2 target sequence
aaacaaattgcaagataagaa

SEQ ID NO: 1559 - DNA, 21 bp, Artificial Sequence
  Ang2 target sequence
aacaaattgcaagataagaac

SEQ ID NO: 1560 - DNA, 21 bp, Artificial Sequence
  Ang2 target sequence
aaattgcaagataagaacagt

SEQ ID NO: 1561 - DNA, 21 bp, Artificial Sequence
  Ang2 target sequence
aattgcaagataagaacagtt

SEQ ID NO: 1562 - DNA, 21 bp, Artificial Sequence
  Ang2 target sequence
aagataagaacagtttcctag

SEQ ID NO: 1563 - DNA, 21 bp, Artificial Sequence
  Ang2 target sequence
aagaacagtttcctagaaaag

SEQ ID NO: 1564 - DNA, 21 bp, Artificial Sequence
  Ang2 target sequence
aacagtttcctagaaaagaag

SEQ ID NO: 1565 - DNA, 21 bp, Artificial Sequence
  Ang2 target sequence
aaaagaaggtgctagctatgg

SEQ ID NO: 1566 - DNA, 21 bp, Artificial Sequence
  Ang2 target sequence
aaagaaggtgctagctatgga

SEQ ID NO: 1567 - DNA, 21 bp, Artificial Sequence
  Ang2 target sequence
aagaaggtgctagctatggaa

SEQ ID NO: 1568 - DNA, 21 bp, Artificial Sequence
  Ang2 target sequence
aaggtgctagctatggaagac

SEQ ID NO: 1569 - DNA, 21 bp, Artificial Sequence
  Ang2 target sequence
aagacaagcacatcatccaac

SEQ ID NO: 1570 - DNA, 21 bp, Artificial Sequence
  Ang2 target sequence
aagcacatcatccaactacag

SEQ ID NO: 1571 - DNA, 21 bp, Artificial Sequence
  Ang2 target sequence
aactacagtcaataaaagaag

SEQ ID NO: 1572 - DNA, 21 bp, Artificial Sequence
  Ang2 target sequence
aataaaagaagagaaagatca

SEQ ID NO: 1573 - DNA, 21 bp, Artificial Sequence
  Ang2 target sequence
aaaagaagagaaagatcagct

SEQ ID NO: 1574 - DNA, 21 bp, Artificial Sequence
  Ang2 target sequence
aaagaagagaaagatcagcta

SEQ ID NO: 1575 - DNA, 21 bp, Artificial Sequence
  Ang2 target sequence
aagaagagaaagatcagctac

SEQ ID NO: 1576 - DNA, 21 bp, Artificial Sequence
  Ang2 target sequence
aagagaaagatcagctacagg

SEQ ID NO: 1577 - DNA, 21 bp, Artificial Sequence
  Ang2 target sequence
aaagatcagctacaggtgtta

SEQ ID NO: 1578 - DNA, 21 bp, Artificial Sequence
  Ang2 target sequence
aagatcagctacaggtgttag

SEQ ID NO: 1579 - DNA, 21 bp, Artificial Sequence
  Ang2 target sequence
aagcaaaattccatcattgaa

SEQ ID NO: 1580 - DNA, 21 bp, Artificial Sequence
  Ang2 target sequence
aaaattccatcattgaagaac

SEQ ID NO: 1581 - DNA, 21 bp, Artificial Sequence
  Ang2 target sequence
aaattccatcattgaagaact

SEQ ID NO: 1582 - DNA, 21 bp, Artificial Sequence
  Ang2 target sequence
aattccatcattgaagaacta

SEQ ID NO: 1583 - DNA, 21 bp, Artificial Sequence
  Ang2 target sequence
aagaactagaaaaaaaaatag

SEQ ID NO: 1584 - DNA, 21 bp, Artificial Sequence
  Ang2 target sequence
aactagaaaaaaaaatagtga

SEQ ID NO: 1585 - DNA, 21 bp, Artificial Sequence
  Ang2 target sequence
aaaaaaaaatagtgactgcca

SEQ ID NO: 1586 - DNA, 21 bp, Artificial Sequence
  Ang2 target sequence
aaaaaaaatagtgactgccac

SEQ ID NO: 1587 - DNA, 21 bp, Artificial Sequence
  Ang2 target sequence
aaaaaaatagtgactgccacg

SEQ ID NO: 1588 - DNA, 21 bp, Artificial Sequence
  Ang2 target sequence
aaaaaatagtgactgccacgg

SEQ ID NO: 1589 - DNA, 21 bp, Artificial Sequence
  Ang2 target sequence
aaaaatagtgactgccacggt

SEQ ID NO: 1590 - DNA, 21 bp, Artificial Sequence
  Ang2 target sequence
aaaatagtgactgccacggtg

SEQ ID NO: 1591 - DNA, 21 bp, Artificial Sequence
  Ang2 target sequence
aaatagtgactgccacggtga

SEQ ID NO: 1592 - DNA, 21 bp, Artificial Sequence
  Ang2 target sequence
aatagtgactgccacggtgaa

SEQ ID NO: 1593 - DNA, 21 bp, Artificial Sequence
  Ang2 target sequence
aataattcagttcttcaaaag

SEQ ID NO: 1594 - DNA, 21 bp, Artificial Sequence
  Ang2 target sequence
aattcagttcttcaaaagcag

SEQ ID NO: 1595 - DNA, 21 bp, Artificial Sequence
  Ang2 target sequence
aaaagcagcaacatgatctca

SEQ ID NO: 1596 - DNA, 21 bp, Artificial Sequence
  Ang2 target sequence
aaagcagcaacatgatctcat

SEQ ID NO: 1597 - DNA, 21 bp, Artificial Sequence
  Ang2 target sequence
aagcagcaacatgatctcatg

SEQ ID NO: 1598 - DNA, 21 bp, Artificial Sequence
  Ang2 target sequence
aacatgatctcatggagacag

SEQ ID NO: 1599 - DNA, 21 bp, Artificial Sequence
  Ang2 target sequence
aataacttactgactatgatg

SEQ ID NO: 1600 - DNA, 21 bp, Artificial Sequence
  Ang2 target sequence
aacttactgactatgatgtcc

SEQ ID NO: 1601 - DNA, 21 bp, Artificial Sequence
  Ang2 target sequence
aaactcagctaaggaccccac

SEQ ID NO: 1602 - DNA, 21 bp, Artificial Sequence
  Ang2 target sequence
aactcagctaaggaccccact

SEQ ID NO: 1603 - DNA, 21 bp, Artificial Sequence
  Ang2 target sequence
aaggaccccactgttgctaaa

SEQ ID NO: 1604 - DNA, 21 bp, Artificial Sequence
  Ang2 target sequence
aaagaagaacaaatcagcttc

SEQ ID NO: 1605 - DNA, 21 bp, Artificial Sequence
  Ang2 target sequence
aagaagaacaaatcagcttca

SEQ ID NO: 1606 - DNA, 21 bp, Artificial Sequence
  Ang2 target sequence
aagaacaaatcagcttcagag

SEQ ID NO: 1607 - DNA, 21 bp, Artificial Sequence
  Ang2 target sequence
aacaaatcagcttcagagact

SEQ ID NO: 1608 - DNA, 21 bp, Artificial Sequence
  Ang2 target sequence
aaatcagcttcagagactgtg

SEQ ID NO: 1609 - DNA, 21 bp, Artificial Sequence
  Ang2 target sequence
aatcagcttcagagactgtgc

SEQ ID NO: 1610 - DNA, 21 bp, Artificial Sequence
  Ang2 target sequence
aagtattcaaatcaggacaca

SEQ ID NO: 1611 - DNA, 21 bp, Artificial Sequence
  Ang2 target sequence
aaatcaggacacaccacaaat

SEQ ID NO: 1612 - DNA, 21 bp, Artificial Sequence
  Ang2 target sequence
aatcaggacacaccacaaatg

SEQ ID NO: 1613 - DNA, 21 bp, Artificial Sequence
  Ang2 target sequence
aaatggcatctacacgttaac

SEQ ID NO: 1614 - DNA, 21 bp, Artificial Sequence
  Ang2 target sequence
aatggcatctacacgttaaca

SEQ ID NO: 1615 - DNA, 21 bp, Artificial Sequence
  Ang2 target sequence
aacattccctaattctacaga

SEQ ID NO: 1616 - DNA, 21 bp, Artificial Sequence
  Ang2 target sequence
aattctacagaagagatcaag

SEQ ID NO: 1617 - DNA, 21 bp, Artificial Sequence
  Ang2 target sequence
aagagatcaaggcctactgtg

SEQ ID NO: 1618 - DNA, 21 bp, Artificial Sequence
  Ang2 target sequence
aaggcctactgtgacatggaa

SEQ ID NO: 1619 - DNA, 21 bp, Artificial Sequence
  Ang2 target sequence
aagctggaggaggcgggtgga

SEQ ID NO: 1620 - DNA, 21 bp, Artificial Sequence
  Ang2 target sequence
aattattcagcgacgtgagga

SEQ ID NO: 1621 - DNA, 21 bp, Artificial Sequence
  Ang2 target sequence
aaagaatataaagtgggattt

SEQ ID NO: 1622 - DNA, 21 bp, Artificial Sequence
  Ang2 target sequence
aagaatataaagtgggatttg

SEQ ID NO: 1623 - DNA, 21 bp, Artificial Sequence
  Ang2 target sequence
aatataaagtgggatttggta

SEQ ID NO: 1624 - DNA, 21 bp, Artificial Sequence
  Ang2 target sequence
aaagtgggatttggtaaccct

SEQ ID NO: 1625 - DNA, 21 bp, Artificial Sequence
  Ang2 target sequence
aagtgggatttggtaaccctt

SEQ ID NO: 1626 - DNA, 21 bp, Artificial Sequence
  Ang2 target sequence
aacccttcaggagaatattgg

SEQ ID NO: 1627 - DNA, 21 bp, Artificial Sequence
  Ang2 target sequence
aatattggctgggaaatgagt

SEQ ID NO: 1628 - DNA, 21 bp, Artificial Sequence
  Ang2 target sequence
aaatgagtttgtttcgcaact

SEQ ID NO: 1629 - DNA, 21 bp, Artificial Sequence
  Ang2 target sequence
aatgagtttgtttcgcaactg

SEQ ID NO: 1630 - DNA, 21 bp, Artificial Sequence
  Ang2 target sequence
aactgactaatcagcaacgct

SEQ ID NO: 1631 - DNA, 21 bp, Artificial Sequence
  Ang2 target sequence
aatcagcaacgctatgtgctt

SEQ ID NO: 1632 - DNA, 21 bp, Artificial Sequence
  Ang2 target sequence
aacgctatgtgcttaaaatac

SEQ ID NO: 1633 - DNA, 21 bp, Artificial Sequence
  Ang2 target sequence
aaaatacaccttaaagactgg

SEQ ID NO: 1634 - DNA, 21 bp, Artificial Sequence
  Ang2 target sequence
aaatacaccttaaagactggg

SEQ ID NO: 1635 - DNA, 21 bp, Artificial Sequence
  Ang2 target sequence
aatacaccttaaagactggga

SEQ ID NO: 1636 - DNA, 21 bp, Artificial Sequence
  Ang2 target sequence
aaagactgggaagggaatgag

SEQ ID NO: 1637 - DNA, 21 bp, Artificial Sequence
  Ang2 target sequence
aagactgggaagggaatgagg

SEQ ID NO: 1638 - DNA, 21 bp, Artificial Sequence
  Ang2 target sequence
aagggaatgaggcttactcat

SEQ ID NO: 1639 - DNA, 21 bp, Artificial Sequence
  Ang2 target sequence
aatgaggcttactcattgtat

SEQ ID NO: 1640 - DNA, 21 bp, Artificial Sequence
  Ang2 target sequence
aacatttctatctctcaagtg

SEQ ID NO: 1641 - DNA, 21 bp, Artificial Sequence
  Ang2 target sequence
aagtgaagaactcaattatag

SEQ ID NO: 1642 - DNA, 21 bp, Artificial Sequence
  Ang2 target sequence
aagaactcaattataggattc

SEQ ID NO: 1643 - DNA, 21 bp, Artificial Sequence
  Ang2 target sequence
aactcaattataggattcacc

SEQ ID NO: 1644 - DNA, 21 bp, Artificial Sequence
  Ang2 target sequence
aattataggattcaccttaaa

SEQ ID NO: 1645 - DNA, 21 bp, Artificial Sequence
  Ang2 target sequence
aaaggacttacagggacagcc

SEQ ID NO: 1646 - DNA, 21 bp, Artificial Sequence
  Ang2 target sequence
aaggacttacagggacagccg

SEQ ID NO: 1647 - DNA, 21 bp, Artificial Sequence
  Ang2 target sequence
aaaataagcagcatcagccaa

SEQ ID NO: 1648 - DNA, 21 bp, Artificial Sequence
  Ang2 target sequence
aaataagcagcatcagccaac

SEQ ID NO: 1649 - DNA, 21 bp, Artificial Sequence
  Ang2 target sequence
aataagcagcatcagccaacc

SEQ ID NO: 1650 - DNA, 21 bp, Artificial Sequence
  Ang2 target sequence
aagcagcatcagccaaccagg

SEQ ID NO: 1651 - DNA, 21 bp, Artificial Sequence
  Ang2 target sequence
aaccaggaaatgattttagca

SEQ ID NO: 1652 - DNA, 21 bp, Artificial Sequence
  Ang2 target sequence
aaatgattttagcacaaagga

SEQ ID NO: 1653 - DNA, 21 bp, Artificial Sequence
  Ang2 target sequence
aatgattttagcacaaaggat

SEQ ID NO: 1654 - DNA, 21 bp, Artificial Sequence
  Ang2 target sequence
aaaggatggagacaacgacaa

SEQ ID NO: 1655 - DNA, 21 bp, Artificial Sequence
  Ang2 target sequence
aaggatggagacaacgacaaa

SEQ ID NO: 1656 - DNA, 21 bp, Artificial Sequence
  Ang2 target sequence
aacgacaaatgtatttgcaaa

SEQ ID NO: 1657 - DNA, 21 bp, Artificial Sequence
  Ang2 target sequence
aaatgtatttgcaaatgttca

SEQ ID NO: 1658 - DNA, 21 bp, Artificial Sequence
  Ang2 target sequence
aatgtatttgcaaatgttcac

SEQ ID NO: 1659 - DNA, 21 bp, Artificial Sequence
  Ang2 target sequence
aaatgttcacaaatgctaaca

SEQ ID NO: 1660 - DNA, 21 bp, Artificial Sequence
  Ang2 target sequence
aatgttcacaaatgctaacag

SEQ ID NO: 1661 - DNA, 21 bp, Artificial Sequence
  Ang2 target sequence
aaatgctaacaggaggctggt

SEQ ID NO: 1662 - DNA, 21 bp, Artificial Sequence
  Ang2 target sequence
aatgctaacaggaggctggtg

SEQ ID NO: 1663 - DNA, 21 bp, Artificial Sequence
  Ang2 target sequence
aacaggaggctggtggtttga

SEQ ID NO: 1664 - DNA, 21 bp, Artificial Sequence
  Ang2 target sequence
aacttgaacggaatgtactat

SEQ ID NO: 1665 - DNA, 21 bp, Artificial Sequence
  Ang2 target sequence
aacggaatgtactatccacag

SEQ ID NO: 1666 - DNA, 21 bp, Artificial Sequence
  Ang2 target sequence
aatgtactatccacagaggca

SEQ ID NO: 1667 - DNA, 21 bp, Artificial Sequence
  Ang2 target sequence
aacacaaataagttcaacggc

SEQ ID NO: 1668 - DNA, 21 bp, Artificial Sequence
  Ang2 target sequence
aaataagttcaacggcattaa

SEQ ID NO: 1669 - DNA, 21 bp, Artificial Sequence
  Ang2 target sequence
aataagttcaacggcattaaa

SEQ ID NO: 1670 - DNA, 21 bp, Artificial Sequence
  Ang2 target sequence
aagttcaacggcattaaatgg

SEQ ID NO: 1671 - DNA, 21 bp, Artificial Sequence
  Ang2 target sequence
aacggcattaaatggtactac

SEQ ID NO: 1672 - DNA, 21 bp, Artificial Sequence
  Ang2 target sequence
aaatggtactactggaaaggc

SEQ ID NO: 1673 - DNA, 21 bp, Artificial Sequence
  Ang2 target sequence
aatggtactactggaaaggct

SEQ ID NO: 1674 - DNA, 21 bp, Artificial Sequence
  Ang2 target sequence
aaaggctcaggctattcgctc

SEQ ID NO: 1675 - DNA, 21 bp, Artificial Sequence
  Ang2 target sequence
aaggctcaggctattcgctca

SEQ ID NO: 1676 - DNA, 21 bp, Artificial Sequence
  Ang2 target sequence
agcctataacaactttcggaa

SEQ ID NO: 1677 - DNA, 21 bp, Artificial Sequence
  Ang2 target sequence
atcaggtccagcatgggtcct

SEQ ID NO: 1678 - DNA, 21 bp, Artificial Sequence
  Ang2 target sequence
gacaactgccgctcttcctcc

SEQ ID NO: 1679 - DNA, 21 bp, Artificial Sequence
  Ang2 target sequence
ctcgaatacgatgactcggtg

SEQ ID NO: 1680 - DNA, 21 bp, Artificial Sequence
  Ang2 target sequence
tggctaatgaagcttgagaat

SEQ ID NO: 1681 - DNA, 21 bp, Artificial Sequence
  Ang2 target sequence
tccaggacaacatgaagaaag

SEQ ID NO: 1682 - DNA, 21 bp, Artificial Sequence
  Ang2 target sequence
acggctgtgatgatagaaata

SEQ ID NO: 1683 - DNA, 21 bp, Artificial Sequence
  Ang2 target sequence
gcaaacgcggaagttaactga

SEQ ID NO: 1684 - DNA, 21 bp, Artificial Sequence
  Ang2 target sequence
cagaccacgagacttgaactt

SEQ ID NO: 1685 - DNA, 21 bp, Artificial Sequence
  Ang2 target sequence
ccagaccagtgaaataaacaa

SEQ ID NO: 1686 - DNA, 21 bp, Artificial Sequence
  Ang2 target sequence
tgcaagataagaacagtttcc

SEQ ID NO: 1687 - DNA, 21 bp, Artificial Sequence
  Ang2 target sequence
tacagtcaataaaagaagaga

SEQ ID NO: 1688 - DNA, 21 bp, Artificial Sequence
  Ang2 target sequence
ttagtatccaagcaaaattcc

SEQ ID NO: 1689 - DNA, 21 bp, Artificial Sequence
  Ang2 target sequence
actgccacggtgaataattca

SEQ ID NO: 1690 - DNA, 21 bp, Artificial Sequence
  Ang2 target sequence
atgatgtccacatcaaactca

SEQ ID NO: 1691 - DNA, 21 bp, Artificial Sequence
  Ang2 target sequence
gtgctgaagtattcaaatcag

SEQ ID NO: 1692 - DNA, 21 bp, Artificial Sequence
  Ang2 target sequence
gatcaaggcctactgtgacat

SEQ ID NO: 1693 - DNA, 21 bp, Artificial Sequence
  Ang2 target sequence
attcagcgacgtgaggatggc

SEQ ID NO: 1694 - DNA, 21 bp, Artificial Sequence
  Ang2 target sequence
ttcagaggacttggaaagaat

SEQ ID NO: 1695 - DNA, 21 bp, Artificial Sequence
  Ang2 target sequence
tcgcaactgactaatcagcaa

SEQ ID NO: 1696 - DNA, 21 bp, Artificial Sequence
  Ang2 target sequence
agactgggaagggaatgaggc

SEQ ID NO: 1697 - DNA, 21 bp, Artificial Sequence
  Ang2 target sequence
actcattgtatgaacatttct

SEQ ID NO: 1698 - DNA, 21 bp, Artificial Sequence
  Ang2 target sequence
cagccggcaaaataagcagca

SEQ ID NO: 1699 - DNA, 21 bp, Artificial Sequence
  Ang2 target sequence
tagcacaaaggatggagacaa

SEQ ID NO: 1700 - DNA, 21 bp, Artificial Sequence
  Ang2 target sequence
gttcacaaatgctaacaggag

SEQ ID NO: 1701 - DNA, 21 bp, Artificial Sequence
  Ang2 target sequence
tgtactatccacagaggcaga

SEQ ID NO: 1702 - DNA, 21 bp, Artificial Sequence
  Ang2 target sequence
cggcattaaatggtactactg

SEQ ID NO: 1703 - DNA, 21 bp, Artificial Sequence
  Ang2 target sequence
caaggccacaaccatgatgat

SEQ ID NO: 1704 - DNA, 777 bp, Homo sapiens
  CDS (29)..(775)
ctgagatcaccggcgaaggagggccaccatggcgcacgctgggagaagtggttacgataaccgggagatagtgatgaagtacatccattataagctgtcgcagaggggctacgagtgggatgcgggagatgtgggcgccgcgcccccgggggccgcccccgcaccgggcttcttctcctcccagcccgggcacacgccccatccagccgcatcccgggacccggtcgccaggacctcgccactacagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgcgcggggatgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggatgcctttgtggaactgtacggccccagcatgcggcctctgtttgatttctcctggctgtctctgaagactctgctcagtttggccctggtgggagcttgcatcaccctgggtgcctatctgggccacaagtgaagtcaacatgcctgccccaaacaaatatg

SEQ ID NO: 1705 - protein, 239 aa, Homo sapiens [sequence omitted]

SEQ ID NO: 1706 - DNA, 741 bp, Mus musculus
  CDS (2)..(709)
catggcgcaagccgggagaacagggtatgataaccgggagatcgtgatgaagtacatacattataagctgtcacagaggggctacgagtgggatgctggagatgcggacgcggcgcccctgggggctgcccccacccctggcatcttctccttccagcctgagagcaacccaatgcccgctgtgcaccgggacatggctgccaggacgtctcctctcaggcccctcgttgccaccgctgggcctgcgctcagccctgtgccacctgtggtccatctgaccctccgccgggctggggatgacttctctcgtcgctaccgtcgtgacttcgcagagatgtccagtcagctgcacctgacgcccttcaccgcgaggggacgctttgccacggtggtggaggaactcttcagggatggggtgaactgggggaggattgtggccttctttgagttcggtggggtcatgtgtgtggagagcgtcaacagggagatgtcacccctggtggacaacatcgccctgtggatgactgagtacctgaaccggcatctgcacacctggatccaggataacggaggctgggatgcctttgtggaactatatggccccagcatgcgacctctgtttgatttctcctggctgtctctgaagaccctgctcagcctggccctggtcggggcctgcatcactctgggtgcatacctgggccacaagtgaggtcgacaaacctgccccaaacaaatatg

SEQ ID NO: 1707 - protein, 236 aa, Mus musculus
MAQAGRTGYDNREIVMKYIHYKLSQRGYEWDAGDADAAPLGAAPTPGIFSFQPESNPMPAVHRDMAARTSPLRPLVATAGPALSPVPPVVHLTLRRAGDDFSRRYRRDFAEMSSQLHLTPFTARGRFATVVEELFRDGVNWGRIVAFFEFGGVMCVESVNREMSPLVDNIALWMTEYLNRHLHTWIQDNGGWDAFVELYGPSMRPLFDFSWLSLKTLLSLALVGACITLGAYLGHK

SEQ ID NO: 1708 - DNA, 733 bp, Homo sapiens
  CDS (27)..(725)
ctgagatcaccggtaggagggccatcatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgtgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaattcg

SEQ ID NO: 1709 - protein, 233 aa, Homo sapiens
MSQSNRELVVDFLSYKLSQKGYSWSQFSDVEENRTEAPEGTESEMETPSAINGNPSWHLADSPAVNGATGHSSSLDAREVIPMAAVKQALREAGDEFELRYRRAFSDLTSQLHITPGTAYQSFEQVVNELFRDGVNWGRIVAFFSFGGALCVESVDKEMQVLVSRIAAWMATYLNDHLEPWIQENGGWDTFVELYGNNAAAESRKGQERFNRWFLTGMTVAGVVLLGSLFSRK

SEQ ID NO: 1710 - DNA, 550 bp, Homo sapiens
  CDS (27)..(530)
ctgagatcaccggtaggagggccaacatgttccagatcccagagtttgagccgagtgagcaggaagactccagctctgcagagaggggcctgggccccagccccgcaggggacgggccctcaggctccggcaagcatcatcgccaggccccaggcctcctgtgggacgccagtcaccagcaggagcagccaaccagcagcagccatcatggaggcgctggggctgtggagatccggagtcgccacagctcctaccccgcggggacggaggacgacgaagggatgggggaggagcccagcccctttcggggccgctcgcgctcggcgccccccaacctctgggcagcacagcgctatggccgcgagctccggaggatgagtgacgagtttgtggactcctttaagaagggacttcctcgcccgaagagcgcgggcacagcaacgcagatgcggcaaagctccagctggacgcgagtcttccagtcctggtgggatcggaacttgggcaggggaagctccgccccctcccagtgaccttcgctccacatccg

SEQ ID NO: 1711 - protein, 168 aa, Homo sapiens
MFQIPEFEPSEQEDSSSAERGLGPSPAGDGPSGSGKHHRQAPGLLWDASHQQEQPTSSSHHGGAGAVEIRSRHSSYPAGTEDDEGMGEEPSPFRGRSRSAPPNLWAAQRYGRELRRMSDEFVDSFKKGLPRPKSAGTATQMRQSSSWTRVFQSWWDRNLGRGSSAPSQ

SEQ ID NO: 1712 - DNA, 644 bp, Mus musculus
  CDS (2)..(613)
catgggaaccccaaagcagccctcgctggctcctgcacacgccctaggcttgaggaagtccgatcccggaatccggagcctggggagcgacgcgggaggaaggcggtggagaccagcagcccagagtatgttccagatcccagagtttgagccgagtgagcaggaagacgctagtgctacagataggggcctgggccctagcctcactgaggaccagccaggtccctacctggccccaggtctcctggggagcaacattcatcagcagggacgggcagccaccaacagtcatcatggaggcgcaggggctatggagactcggagtcgccacagttcgtacccagcggggaccgaggaggatgaagggatggaggaggagcttagcccttttcgaggacgctcgcgttcggctccccccaatctctgggcagcgcagcgctacggccgtgagctccgaaggatgagcgatgagtttgagggttccttcaagggacttcctcgcccaaagagcgcaggcactgcaacacagatgcgacaaagcgccggctggacgcgcattatccagtcctggtgggatcgaaacttgggcaaaggaggctccaccccctcccagtgatcttctgctccacatcccggaactctag

SEQ ID NO: 1713 - protein, 204 aa, Mus musculus
MGTPKQPSLAPAHALGLRKSDPGIRSLGSDAGGRRWRPAAQSMFQIPEFEPSEQEDASATDRGLGPSLTEDQPGPYLAPGLLGSNIHQQGRAATNSHHGGAGAMETRSRHSSYPAGTEEDEGMEEELSPFRGRSRSAPPNLWAAQRYGRELRRMSDEFEGSFKGLPRPKSAGTATQMRQSAGWTRIIQSWWDRNLGKGGSTPSQ

SEQ ID NO: 1714 - DNA, 729 bp, Homo sapiens
  CDS (29)..(661)
ctgagatcaccggcgaaggagggccaccatggcttcggggcaaggcccaggtcctcccaggcaggagtgcggagagcctgccctgccctctgcttctgaggagcaggtagcccaggacacagaggaggttttccgcagctacgttttttaccgccatcagcaggaacaggaggctgaaggggtggctgcccctgccgacccagagatggtcaccttacctctgcaacctagcagcaccatggggcaggtgggacggcagctcgccatcatcggggacgacatcaaccgacgctatgactcagagttccagaccatgttgcagcacctgcagcccacggcagagaatgcctatgagtacttcaccaagattgccaccagcctgtttgagagtggcatcaattggggccgtgtggtggctcttctgggcttcggctaccgtctggccctacacgtctaccagcatggcctgactggcttcctaggccaggtgacccgcttcgtggtcgacttcatgctgcatcactgcattgcccggtggattgcacagaggggtggctgggtggcagccctgaacttgggcaatggtcccatcctgaacgtgctggtggttctgggtgtggttctgttgggccagtttgtggtacgaagattcttcaaatcatgactcccaagggtgccctttgggtcccggttcagacccctgcctggacttaagcgaagtctttgccg

SEQ ID NO: 1715 - protein, 211 aa, Homo sapiens
MASGQGPGPPRQECGEPALPSASEEQVAQDTEEVFRSYVFYRHQQEQEAEGVAAPADPEMVTLPLQPSSTMGQVGRQLAIIGDDINRRYDSEFQTMLQHLQPTAENAYEYFTKIATSLFESGINWGRVVALLGFGYRLALHVYQHGLTGFLGQVTRFVVDFMLHHCIARWIAQRGGWVAALNLGNGPILNVLVVLGVVLLGQFVVRRFFKS

SEQ ID NO: 1716 - DNA, 609 bp, Homo sapiens
  CDS (29)..(604)
ctgagatcaccggcgaaggagggccaccatggacgggtccggggagcagcccagaggcggggggcccaccagctctgagcagatcatgaagacaggggcccttttgcttcagggtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacactggacttcctccgggagcggctgttgggctggatccaagaccagggtggttgggacggcctcctctcctactttgggacgcccacgtggcagaccgtgaccatctttgtggcgggagtgctcaccgcctcactcaccatctggaagaagatgggctgagc

SEQ ID NO: 1717 - protein, 192 aa, Homo sapiens
MDGSGEQPRGGGPTSSEQIMKTGALLLQGFIQDRAGRMGGEAPELALDPVPQDASTKKLSECLKRIGDELDSNMELQRMIAAVDTDSPREVFFRVAADMFSDGNFNWGRVVALFYFASKLVLKALCTKVPELIRTIMGWTLDFLRERLLGWIQDQGGWDGLLSYFGTPTWQTVTIFVAGVLTASLTIWKKMG

SEQ ID NO: 1718 - DNA, 585 bp, Mus musculus
  CDS (2)..(577)
catggacgggtccggggagcagcttgggagcggcgggcccaccagctctgaacagatcatgaagacaggggcctttttgctacagggtttcatccaggatcgagcagggaggatggctggggagacacctgagctgaccttggagcagccgccccaggatgcgtccaccaagaagctgagcgagtgtctccggcgaattggagatgaactggacagcaatatggagctgcagaggatgattgctgacgtggacacggactccccccgagaggtcttcttccgggtggcagctgacatgtttgctgatggcaacttcaactggggccgcgtggttgccctcttctactttgctagcaaactggtgctcaaggccctgtgcactaaagtgcccgagctgatcagaaccatcatgggctggacactggacttcctccgtgagcggctgcttgtctggatccaagaccagggtggctgggaaggcctcctctcctacttcgggacccccacatggcagacagtgaccatctttgtggctggagtcctcaccgcctcgctcaccatctggaagaagatgggctgaattcg

SEQ ID NO: 1719 - protein, 192 aa, Mus musculus
MDGSGEQLGSGGPTSSEQIMKTGAFLLQGFIQDRAGRMAGETPELTLEQPPQDASTKKLSECLRRIGDELDSNMELQRMIADVDTDSPREVFFRVAADMFADGNFNWGRVVALFYFASKLVLKALCTKVPELIRTIMGWTLDFLRERLLVWIQDQGGWEGLLSYFGTPTWQTVTIFVAGVLTASLTIWKKMG

SEQ ID NO: 1720 - DNA, 551 bp, Homo sapiens
  CDS (27)..(536)
ctgagatcaccggtaggagggccatcatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggatacttttgtggaactctatgggaacaatgcagcagccgagagccgaaagggccaggaacgcttcaaccgctggttcctgacgggcatgactgtggccggcgtggttctgctgggctcactcttcagtcggaaatgaattcgctagctc

SEQ ID NO: 1721 - protein, 170 aa, Homo sapiens
MSQSNRELVVDFLSYKLSQKGYSWSQFSDVEENRTEAPEGTESEMETPSAINGNPSWHLADSPAVNGATGHSSSLDAREVIPMAAVKQALREAGDEFELRYRRAFSDLTSQLHITPGTAYQSFEQDTFVELYGNNAAAESRKGQERFNRWFLTGMTVAGVVLLGSLFSRK

SEQ ID NO: 1722 - DNA, 544 bp, Homo sapiens
  CDS (29)..(508)
ctgagatcaccggcgaaggagggccaccatgtctgaagtaagacccctctccagagacatcttgatggagaccctcctgtatgagcagctcctggaacccccgaccatggaggttcttggcatgactgactctgaagaggacctggaccctatggaggacttcgattctttggaatgcatggagggcagtgacgcattggccctgcggctggcctgcatcggggacgagatggacgtgagcctcagggccccgcgcctggcccagctctccgaggtggccatgcacagcctgggtctggctttcatctacgaccagactgaggacatcagggatgttcttagaagtttcatggacggtttcaccacacttaaggagaacataatgaggttctggagatccccgaaccccgggtcctgggtgtcctgcgaacaggtgctgctggcgctgctgctgctgctggcgctgctgctgccgctgctcagcgggggcctgcacctgctgctcaagtgagcccccggcggctcaggcgtggctggccccacg

SEQ ID NO: 1723 - protein, 160 aa, Homo sapiens
MSEVRPLSRDILMETLLYEQLLEPPTMEVLGMTDSEEDLDPMEDFDSLECMEGSDALALRLACIGDEMDVSLRAPRLAQLSEVAMHSLGLAFIYDQTEDIRDVLRSFMDGFTTLKENIMRFWRSPNPGSWVSCEQVLLALLLLLALLLPLLSGGLHLLLK

SEQ ID NO: 1724 - DNA, 915 bp, Homo sapiens
  CDS (27)..(857)
ctgagatcaccggtaggagggccaccatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgcttctgagccatggtgaagaaggaataatttttggaacaaatggacctgttgacctgaaaaaaataacaaactttttcagaggggatcgttgtagaagtctaactggaaaacccaaacttttcattattcaggcctgccgtggtacagaactggactgtggcattgagacagacagtggtgttgatgatgacatggcgtgtcataaaataccagtggaggccgacttcttgtatgcatactccacagcacctggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcactaaagaaatggttggttggtggttttttttagtttgtatgccaagtgagaagatggtg

SEQ ID NO: 1725 - protein, 277 aa, Homo sapiens
MENTENSVDSKSIKNLEPKIIHGSESMDSGISLDNSYKMDYPEMGLCIIINNKNFHKSTGMTSRSGTDVDAANLRETFRNLKYEVRNKNDLTREEIVELMRDVSKEDHSKRSSFVCVLLSHGEEGIIFGTNGPVDLKKITNFFRGDRCRSLTGKPKLFIIQACRGTELDCGIETDSGVDDDMACHKIPVEADFLYAYSTAPGYYSWRNSKDGSWFIQSLCAMLKQYADKLEFMHILTRVNRKVATEFESFSFDATFHAKKQIPCIVSMLTKELYFYH

SEQ ID NO: 1726 - DNA, 1184 bp, Homo sapiens
acgcgtcccaaaatggaacataaggaagtggttcttctacttcttttatttctgaaatcaggtcaaggagagcctctggatgactatgtgaatacccagggggcttcactgttcagtgtcactaagaagcagctgggagcaggaagtatagaagaatgtgcagcaaaatgtgaggaggacgaagaattcacctgcagggcattccaatatcacagtaaagagcaacaatgtgtgataatggctgaaaacaggaagtcctccataatcattaggatgagagatgtagttttatttgaaaagaaagtgtatctctcagagtgcaagactgggaatggaaagaactacagagggacgatgtccaaaacaaaaaatggcatcacctgtcaaaaatggagttccacttctccccacagacctagattctcacctgctacacacccctcagagggactggaggagaactactgcaggaatccagacaacgatccgcaggggccctggtgctatactactgatccagaaaagagatatgactactgcgacattcttgagtgtgaagaggaatgtatgcattgcagtggagaaaactatgacggcaaaatttccaagaccatgtctggactggaatgccaggcctgggactctcagagcccacacgctcatggatacattccttccaaatttccaaacaagaacctgaagaagaattactgtcgtaaccccgatagggagctgcggccttggtgtttcaccaccgaccccaacaagcgctgggaactttgtgacatcccccgctgcacaacacctccaccatcttctggtcccacctaccagtgtctgaagggaacaggtgaaaactatcgcgggaatgtggctgttaccgtgtccgggcacacctgtcagcactggagtgcacagacccctcacacacataacaggacaccagaaaacttcccctgcaaaaatttggatgaaaactactgccgcaatcctgacggaaaaagggccccatggtgccatacaaccaacagccaagtgcggtgggagtactgtaagataccgtcctgtgactcctccccagtatccacggaacaattggctcccacagcaccacctgagctaacccctgtggtccaggactgctaccatggtgatggacagagctagcgaggcacatcgtcgac

SEQ ID NO: 1727 - DNA, 1282 bp, Homo sapiens
acgcgtcccaggatgcaggccctggtgctactcctctgcattggagccctcctcgggcacagcagctgccagaaccctgccagccccccggaggagggctccccagaccccgacagcacaggggcgctggtggaggaggaggatcctttcttcaaagtccccgtgaacaagctggcagcggctgtctccaacttcggctatgacctgtaccgggtgcgatccagcatgagccccacgaccaacgtgctcctgtctcctctcagtgtggccacggccctctcggccctctcgctgggagcggagcagcgaacagaatccatcattcaccgggctctctactatgacttgatcagcagcccagacatccatggtacctataaggagctccttgacacggtcactgcccgccagaagaacctcaagagtgcctcccggatcgtctttgagaagaagctgcgcataaaatccagctttgtggcacctctggaaaagtcatatgggaccaggcccagagtcctgacgggcaaccctcgcttggacctgcaagagatcaacaactgggtgcaggcgcagatgaaagggaagctcgccaggtccacaaaggaaattcccgatgagatcagcattctccttctcggtgtggcgcacttcaaggggcagtgggtaacaaagtttgactccagaaagacttccctcgaggatttctacttggatgaagagaggaccgtgagggtccccatgatgtcggaccctaaggctgttttacgctatggcttggattcagatctcagctgcaagattgcccagctgcccttgaccggaagcatgagtatcatcttcttcctgcccctgaaagtgacccagaatttgaccttgatagaggagagcctcacctccgagttcattcatgacatagaccgagaactgaagaccgtgcaggcggtcctcactgtccccaagctgaagctgagttacgaaggcgaagtcaccaagtccctgcaggagatgaagctgcaatccttgtttgattcaccagactttagcaagatcacaggcaaacccatcaagctgactcaggtggaacaccgggctggctttgagtggaacgaggatggggcgggaaccacccccagcccagggctgcagcctgcccacctcaccttcccgctggactatcaccttaaccagcctttcatcttcgtactgagggacacagacacaggggcccttctcttcattggcaagattctggaccccaggggcccctaatatcccagtcgac

SEQ ID NO: 1728 - DNA, 63 bp, Artificial Sequence
  hVEGF#5-a insert
gatccacctcaccaaggccagcacttcaagagagtgctggccttggtgaggtttttttggaaa

SEQ ID NO: 1729 - DNA, 63 bp, Artificial Sequence
  hVEGF#5-b insert
agcttttccaaaaaaacctcaccaaggccagcactctcttgaagtgctggccttggtgaggtg

SEQ ID NO: 1730 - DNA, 63 bp, Artificial Sequence
  hVEGF#2-a insert
gatccgttcatggatgtctatcagttcaagagactgatagacatccatgaacttttttggaaa

SEQ ID NO: 1731 - DNA, 63 bp, Artificial Sequence
  hVEGF#2-b insert
agcttttccaaaaaagttcatggatgtctatcagtctcttgaactgatagacatccatgaacg

SEQ ID NO: 1732 - DNA, 63 bp, Artificial Sequence
  hHIF1-alpha#11-a insert
gatccagtcggacagcctcaccaattcaagagattggtgaggctgtccgactttttttggaaa

SEQ ID NO: 1733 - DNA, 63 bp, Artificial Sequence
  hHIF1-alpha#11-b insert
agcttttccaaaaaaagtcggacagcctcaccaatctcttgaattggtgaggctgtccgactg

SEQ ID NO: 1734 - DNA, 21 bp, Artificial
  VEGF target sequence
aaacctcaccaaggccagcac

SEQ ID NO: 1735 - DNA, 63 bp, Artificial; identical to SEQ ID NO: 1728
  VEGF target sequence

SEQ ID NO: 1736 - DNA, 63 bp, Artificial; identical to SEQ ID NO: 1729
  VEGF target sequence

SEQ ID NO: 1737 - RNA, 49 nt, Artificial
  VEGF target sequence
accucaccaaggccagcacuucaagagagugcuggccuuggugagguuu

We claim:

1. A composition comprising a pharmaceutically acceptable carrier and an effective amount of an expression vector, wherein the expression vector comprises at least one RNAi knockdown cassette for expressing an siRNA from about 17 to about 29 nucleotides in length comprising a sequence that is targeted to at least SEQ II) NO: 1, wherein said knockdown cassette comprises SEQ ID NO: 1730, and SEQ ID NO: 1731 and, at least one therapeutic knockdown cassette comprising: SEQ ID NO: 70.

2. The composition of claim 1, wherein the RNAi knockdown cassette encodes a siRNA from about 17 to about 29 nucleotides in length.

3. The composition of claim 1, wherein the expression vector is selected from the group consisting of pCMS, EGFP: PvuII fragment deleted pCMS, pBLAST, pBLAST40, pRLAST45, pORF, pORF9, retrovirus, herpes virus, adenovirus, adeno-associated virus, pAAV comb vector.

4. The composition of claim 1 wherein the RNAi expression cassette is operably linked to a promoter selected from the group consisting of U6 promoter, H1 RNApolIII promoter, and cytomegalovirus promoter.

* * * * *